(12) United States Patent
Apuya

(10) Patent No.: US 12,391,954 B2
(45) Date of Patent: Aug. 19, 2025

(54) TRANSGENIC PLANTS HAVING ALTERED BIOMASS COMPOSITION

(71) Applicant: Ceres, Inc., Thousand Oaks, CA (US)

(72) Inventor: Nestor Apuya, Culver City, CA (US)

(73) Assignee: Ceres, Inc., Thousand Oaks, CA (US)

( * ) Notice: Subject to any disclaimer, the term of this patent is extended or adjusted under 35 U.S.C. 154(b) by 226 days.

(21) Appl. No.: 18/299,406

(22) Filed: Apr. 12, 2023

(65) Prior Publication Data

US 2023/0399654 A1    Dec. 14, 2023

Related U.S. Application Data

(60) Division of application No. 16/593,082, filed on Oct. 4, 2019, now Pat. No. 11,667,925, which is a division of application No. 15/717,773, filed on Sep. 27, 2017, now abandoned, which is a division of application No. 13/828,225, filed on Mar. 14, 2013, now Pat. No. 9,828,608, which is a continuation-in-part of application No. PCT/US2011/057709, filed on Oct. 25, 2011.

(60) Provisional application No. 61/407,282, filed on Oct. 27, 2010.

(51) Int. Cl.
C12N 15/82    (2006.01)

(52) U.S. Cl.
CPC ........ *C12N 15/8261* (2013.01); *Y02A 40/146* (2018.01)

(58) Field of Classification Search
None
See application file for complete search history.

(56) References Cited

U.S. PATENT DOCUMENTS

| | | |
|---|---|---|
| 4,987,071 A | 1/1991 | Cech et al. |
| 5,034,323 A | 7/1991 | Jorgensen et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,538,880 A | 7/1996 | Lundquist et al. |
| 5,766,847 A | 6/1998 | Jackie et al. |
| 5,878,215 A | 3/1999 | Kling et al. |
| 6,013,863 A | 1/2000 | Lundquist et al. |
| 6,114,608 A | 9/2000 | Mettler et al. |
| 6,326,527 B1 | 12/2001 | Kirihara et al. |
| 6,329,571 B1 | 12/2001 | Hiei |
| 6,423,885 B1 | 7/2002 | Waterhouse et al. |
| PP13,008 P2 | 9/2002 | Walsh |
| 6,452,067 B1 | 9/2002 | Bedbrook et al. |
| 6,573,099 B2 | 6/2003 | Graham |
| PP14,743 P2 | 5/2004 | Speichert et al. |
| 6,753,139 B1 | 6/2004 | Baulcombe et al. |
| 6,777,588 B2 | 8/2004 | Waterhouse et al. |
| PP15,193 P2 | 9/2004 | Smith et al. |
| 6,906,244 B2 | 6/2005 | Fischer et al. |
| PP16,176 P3 | 1/2006 | Cosner et al. |
| 7,112,429 B2 | 9/2006 | Ding |
| 7,214,789 B2 | 5/2007 | Pennell |
| 7,312,376 B2 | 12/2007 | Apuya |
| 7,378,571 B2 | 5/2008 | Apuya |
| 7,402,667 B2 | 7/2008 | Cook |
| 7,429,692 B2 | 9/2008 | Dang |
| 7,598,367 B2 | 10/2009 | Cook |
| 8,022,273 B2 | 9/2011 | Christensen et al. |
| 11,667,925 B2 | 6/2023 | Apuya et al. |
| 2003/0175783 A1 | 9/2003 | Waterhouse et al. |
| 2003/0175965 A1 | 9/2003 | Lowe et al. |
| 2003/0180945 A1 | 9/2003 | Wang et al. |
| 2003/0200564 A1 | 10/2003 | Burrell et al. |
| 2004/0034888 A1 | 2/2004 | Liu et al. |
| 2004/0172684 A1 | 9/2004 | Kovalic et al. |
| 2004/0214272 A1 | 10/2004 | La Rosa et al. |
| 2004/0214330 A1 | 10/2004 | Waterhouse et al. |
| 2005/0032221 A1 | 2/2005 | Chang et al. |
| 2006/0015970 A1 | 1/2006 | Pannell et al. |
| 2006/0021083 A1 | 1/2006 | Cook |
| 2006/0041952 A1 | 2/2006 | Cook |
| 2006/0260004 A1 | 11/2006 | Fang |
| 2006/0265788 A1 | 11/2006 | Rommens |
| 2007/0006335 A1 | 1/2007 | Cook |
| 2007/0022495 A1 | 1/2007 | Reuber et al. |
| 2007/0056058 A1 | 3/2007 | Olivier et al. |
| 2009/0094717 A1 | 4/2009 | Troukhan et al. |
| 2011/0167514 A1* | 7/2011 | Brover et al. ............ A23L 7/10 800/290 |

(Continued)

FOREIGN PATENT DOCUMENTS

| | | |
|---|---|---|
| EP | 0 534 858 | 3/1993 |
| WO | WO 97/01952 | 1/1997 |

(Continued)

OTHER PUBLICATIONS

Hill & Preiss (1998) Biochem Biophys Res Commun 244(2):573-77.*
Rhoads et al. (1998) J Biol Chem 273(46):30750-56.*
Guo et al. (2004) Proc Natl Acad Sci USA 101:9205-10.*
Zhang (2003) Curr Opin Plant Biol 6:430-40.*
Whisstock & Lesk (2003) Q Rev Biophys. 36(3):307-40.*
Oraby et al., (2007) Transgenic Res 16739-49.*
Natl. Acad. Sci. Eng. Med (2016) Genetically Engineered Crops: Experiences and Prospects. Wash., DC; Natl. Acad.*
U.S. Appl. No. 60/505,689, filed Sep. 23, 2003, Cook et al.
U.S. Appl. No. 60/518,075, filed Nov. 6, 2003, Pennell et al.

(Continued)

*Primary Examiner* — Russell T Boggs
(74) *Attorney, Agent, or Firm* — Dentons US LLP

(57) ABSTRACT

Methods and materials for modulating biomass composition in plants are disclosed. For example, nucleic acids encoding biomass composition-modulating polypeptides are disclosed as well as methods for using such nucleic acids to transform plant cells. Also disclosed are plants having altered biomass composition and plant products produced from plants having altered biomass composition.

16 Claims, 55 Drawing Sheets

Specification includes a Sequence Listing.

(56) References Cited

U.S. PATENT DOCUMENTS

| | | |
|---|---|---|
| 2011/0185449 A1 | 7/2011 | Dupree et al. |
| 2013/0125263 A1 | 5/2013 | Apuya et al. |

FOREIGN PATENT DOCUMENTS

| | | |
|---|---|---|
| WO | WO 98/36083 | 8/1998 |
| WO | WO 98/53083 | 11/1998 |
| WO | WO 99/32619 | 7/1999 |
| WO | WO 02/46449 | 6/2002 |
| WO | WO 2003/008540 | 1/2003 |
| WO | WO 2005/098007 | 10/2005 |
| WO | WO 2006/005023 | 1/2006 |
| WO | WO 2006/034479 | 3/2006 |
| WO | WO 2006/036864 | 4/2006 |
| WO | WO 2007/044988 | 4/2007 |
| WO | WO 2007/055826 | 5/2007 |
| WO | WO 2007/120989 | 10/2007 |
| WO | WO 2007/127501 | 11/2007 |
| WO | WO 2008/153927 | 12/2008 |
| WO | WO 2009/059176 | 5/2009 |
| WO | WO 2009/099899 | 8/2009 |
| WO | WO 2009/146015 | 12/2009 |
| WO | WO 2010/124953 | 11/2010 |
| WO | WO 2011/044254 | 4/2011 |
| WO | WO 2012/009551 | 1/2012 |
| WO | WO 2012/058223 | 5/2012 |

OTHER PUBLICATIONS

U.S. Appl. No. 60/544,771, filed Feb. 13, 2004, Cook et al.
U.S. Appl. No. 60/558,869, filed Apr. 1, 2004, Cook et al.
U.S. Appl. No. 60/583,609, filed Jun. 30, 2004, Alexandrov.
U.S. Appl. No. 60/583,691, filed Jun. 30, 2004, Alexandrov et al.
U.S. Appl. No. 60/612,891, filed Sep. 23, 2004, Kwok.
U.S. Appl. No. 60/637,140, filed Dec. 16, 2004, Feldmann.
Kumar, Prateek, et al., "Predicting the effects of coding non-synonymous variants on protein function using the SIFT algorithm," Nature Publishing Group, vol. 4, No. 8, 2009, pp. 1073-1082.
Reva, Boris, et al., "Predicting the functional impact of protein mutations: application to cancer genomics," Nucleic Acids Research, 2011, vol. 39, No. 17, pp. 1-14.
NG, Pauline C., et al., "Predicting the Effects off Amino Acid Substitutions on Protein Function," Annu. Rev. Genomics Hum. Genet. 2006, pp. 61-80.
Guerois, Raphael, "Predicting Changes in the Stability of Proteins and Protein Complexes: A Study of More Than 1000 Mutations," J. Mol. Biol. (2002) 320, 369-387.
Chatterjee et al., Plant Sci 168:501-09 (2005).
Chi-Ham et al., Nat Biotech 28(1):32-36 (2010).
Guo et al., Proc Natl Acad Sci USA 101:9205-10 (2004).
Hill & Preiss, Biochem Biophys Res Commun 244(2):573-77 (1998).
Rennie et al., Plant Cell 26:3314-25 (2014).
Rhoads et al., J Biol Chem 273(46):30750-56 (1998).
UniProtQ8GWB7_At5g18480_2003.
USPTO Written Description Training Materials (2008).
Whisstock & Lesk, Q Rev Biophys. 36(3):307-40 (2003).
Zhang et al., Curr Opin Plant Biol 6:430-40 (2003).
National Center for Biotechnology Information GenBank Accession No. )34_002454034, "The Sorghum bicolor genome and the diversification of grasses," Jul. 13, 2009, 2 pages.
National Center for Biotechnology Information GenBank Accession No. )34_002454032, "The Sorghum bicolor genome and the diversification of grasses," Jul. 13, 2009, 2 pages.
National Center for Biotechnology Information GenBank Accession No. )34_002313331, "The genome of black cottonwood, Populus trichocarpa (Torr. & Gray)," Dec. 31, 2013, 2 pages.
National Center for Biotechnology Information GenBank Accession No. XP_002454079, "The Sorghum bicolor genome and the diversification of grasses," Jul. 13, 2009, 2 pages.
National Center for Biotechnology Information GenBank Accession No. XP_002313367, "The genome of black cottonwood, Populus trichocarpa (Torr. & Gray)," Dec. 31, 2013, 2 pages.
National Center for Biotechnology Information GenBank Accession No. XP_002454077, "The Sorghum bicolor genome and the diversification of grasses," Jul. 13, 2009, 2 pages.
National Center for Biotechnology Information GenBank Accession No. ABK96536, "Analysis of 4,664 high-quality sequence-finished poplar full-length cDNA clones and their utility for the discovery of genes responding to insect feeding," Mar. 24, 2009, 2 pages.
"Heavy metal transport/detoxification protein," UniProtKB-A2Q5G7, Mar. 6, 2007, retrieved on Apr. 11, 2016, http://www.uniprot.org/uniprot/A2Q5G7, 5 pages.
International Search Report and Written Opinion in International Application No. PCT/US2011/057709, dated Jan. 17, 2012, 20 pages.
Aasland et al., "The SANT domain: a putative DNA-binding domain in the SWI-SNF and ADA complexes, the transcriptional co-repressor N-CoR and TFIIIB," Trends Biochem Sci. 1996.
Abler and Scandalios, "Isolation and characterization of a genomic sequence encoding the maize Cat3 catalase gene," Plant Molecular Biology, 1993, 22:1031-1038.
Akashi et al., "Gene Discovery by Ribozyme and siRNA Libraries," Nature Reviews Mol. Cell Biology, May 2005, 6:413-422.
Alonso-Blanco et al., "Arabidopsis Protocols," Methods in Molecular Biology, 1998, 82:137-146.
Baerson et al., "Developmental regulation of an acyl carrier protein gene promoter in vegetative and reproductive tissues," Plant Mol. Biol., 1993, 22(2):255-267.
Bateman et al., "Pfam 3.1: 1313 multiple alignments and profile HMMs match the majority of proteins," Nucl. Acids Res., 1999, 27:260-262.
Bode et al., "Refined 1.2 A crystal structure of the complex formed between subtilisin Carlsberg and the inhibitor eglin c. Molecular structure of eglin and its detailed interaction with subtilisin," EMBO.
Braga et al., "Expression of the CrylAb Protein in Genetically Modified Sugarcane for the Control of Diatraea saccharalis (Lepidoptera: Crambidae)," Journal of New Seeds, 2003, 5:209-221.
Burr et al., "Gene Mapping with Recombinant Inbreds in Maize," Genetics, 1998, 118: 519-526.
Burr et al., "Mapping Genes with Recombinant Inbreds," The Maize Handbook, 1994, pp. 249-254.
Bustos et al., "Regulation of B-Glucuronidase Expression in Transgenic Tobacco Plants by an A/TRich, cis-Acting Sequence Found Upstream of a French Bean B-Phaseolin Gene," The Plant Cell.
Cerdan et al., "A 146 bp fragment of the tobacco Lhcbl*2 promoter confers very-low-fluence and high-irradiance responses of phytochrome to a minimal CaMV 35S promoter," Plant Mol. Biol.
Chen et al., "Functional analysis of regulatory elements in a plant embryo-specific gene," Proc. Natl. Acad. Sci. USA, 1986, 83:8560-8564.
Chenna et al., "Multiple sequence alignment with the Clustal series of programs," Nucleic Acids Res., 2003, 31(13):3497-500.
Christian, et al., "Targeting DNA Double-Strand Breaks with TAL Effector Nucleases," Genetics, Oct. 2010, 186: 757-761.
Conceicao, "A cotyledon regulatory region is responsible for the different spatial expression patterns of Arabidopsis 2S albumin genes," The Plant Journal, 1994, 5:493-505.
Conkling et al., "Isolation of Transcriptionally Regulated Root-Specific Genes from Tobacco," Plant Physiol., 1990, 93:1203-1211.
Dai et al., "RF2b, a rice bZIP transcription activator, interacts with RF2a and is involved in symptom development of rice tungro disease," Proc. Natl. Acad. Sci. USA, 2004, 101(2):687-692.
De Feyter and Gaudron, "Expressing Ribozymes in Plants," Methods in Molecular Biology, 74(43).
Deshpande MV, "Ethanol production from cellulose by coupled saccharification/fermentation using Saccharomyces cerevisiae and cellulose complex from Sclerotium rolfsii UV-8 mutant," Appl.
Dieffenbach and Dveksler, eds., "PCR Primer: A Laboratory Manual," Cold Spring Harbor Laboratory Press, 1995.
Do et al., "ProbCons: Probabilistic consistency-based multiple sequence alignment," Genome Res., 2005, 15(2):330-40.

(56) References Cited

OTHER PUBLICATIONS

Durbin et al., Biological Sequence Analysis: Probabilistic Models of Proteins and Nucleic Acids, Cambridge University Press, Cambridge, UK (1998).
Fejes et al., "A 268 bp upstream sequence mediates the circadian clock-regulated transcription of the wheat Cab-1 gene in transgenic plants," Plant Mol. Biol., 1990, 15:921-932.
Fromm et al., An Octopine Synthase Enhancer Element Directs Tissue-Specific Expression and Binds ASF-1, a Factor from Tobacco Nuclear Extracts, the Plant Cell, 1989, 1:977-984.
Gardiner et al., "Development of a Core RFLP Map in Maize Using an Immortalized F2 Population," Genetics Society of America, 1993, 134: 917-930.
GenBank Accession No. AF096096 GI: AF096096, "*Arabidopsis thaliana* fertilization-independent seed 2 protein (FIS2) mRNA, complete cds," dated Jan. 1999, 2 pages.
GenBank Accession No. AF129516 GI: AF129516, "*Arabidopsis thaliana* fertilization-independent endosperm protein (FIE) mRNA, complete cds," dated Apr. 1999, 2 pages.
GenBank Accession No. L05934 GI: L05934, "*Zea mays* catalase (Cat3) gene, complete cds," Oct. 1993, 3 pages.
GenBank Accession No. U93215, dated Feb. 2002, 42 pages.
Green et al., "Binding site requirements for pea nuclear protein factor GT-1 correlate with sequences required for light-dependent transcriptional activation of the rbcS-3A gene," The EMBO J., 1988,.
Hong et al., "Promoter sequences from two different *Brassica napus* tapetal oleosin-like genes direct tapetal expression of B-glucuronidase in transgenic *Brassica* plants," Plant Mol. Biol., 1997.
Hyrup et al., "Peptide Nucleic Acids (PNA): Synthesis, Properties and Potential Applications," Bioorganic & Medicinal Chemistry, 1996, 4(1):5-23.
Jordano et al., "A Sunflower Helianthinin Gene Upstream Sequence Ensemble Contains an Enhancer and Sites of Nuclear Protein Interaction," The Plant Cell, 1989, 1:855-866.
Kasuga et al., "Improving plant drought, salt, and freezing tolerance by gene transfer of a single stress-inducible transcription factor," Nature Biotechnology, 1999, 17: 287-291.
Keller and Baumgartner, "Vascular-Specific Expression of the Bean GRP 1.8 Gene is Negatively Regulated," The Plant Cell, 1991, 3(10):1051-1061.
Lam et al., "Site-specific mutations alter in vitro factor binding and change promoter expression pattern in transgenic plants," Proc. Natl. Acad. Sci. USA, 1989, 86:7890-7894.
Li et al., "Small dsRNAs induce transcriptional activation in human cells," Proc Natl Acad Sci USA, 2006, 103(46):17337-42.
Lloyd et al., "Targeted mutagenesis using zinc-finger nucleases in *Arabidopsis*," Proc. Natl. Acad. Sci. USA, Feb. 2005, 102:2232-2237.
Luan et al., A Rice cab Gene Promoter Contains Separate cis-Acting Elements That Regulate Expression in Dicot and Monocot Plants, the Plant Cell, Aug. 1992, 4:971-981.
Lubberstedt et al., "Promoters from Genes for Plastid Proteins Possess Regions with Different Sensitivities toward Red and Blue Light," Plant Physiol., 1994, 104:997-1006.
Matsuoka et al., "Tissue-specific light-regulated expression directed by the promoter of a C4 gene, maize pyruvate, orthophosphate dikinase, in a C3 plant, rice," Proc. Natl. Acad. Sci. USA, October.
Matzke and Birchler, "RNAi-Mediated Pathways in the Nucleus," Nature Reviews Genetics, Jan. 2005, 6:24-35.
McCallum et al., "Targeted screening for induced mutations," Nature Biotechnology, Apr. 2000, 18: 455-457.
Medberry et al., "The Commelina Yellow Mottle Virus Promoter Is a Strong Promoter in Vascular and Reproductive Tissues," The Plant Cell, Feb. 1992, 4(2):185-192.
Meier et al., "Elicitor-Inducible and Constitutive in Vivo DNA Footprints Indicate Novel cis-Acting Elements in the Promoter of a Parsley Gene Encoding Pathogenesis-Related Protein 1," The Plant.
Mittal, "Improving the Efficiency of RNA Interference in Mammals," Nature Reviews Genetics, May 2004, 5:355-365.
Moore and Haber, "Cell cycle and genetic requirements of two pathways of nonhomologous endjoining repair of double-strand breaks in *Saccharomyces cerevisiae*," Mol Cell Biol., May 1996.
Nature.Com, "Nature Reviews RNA interference collection," Oct. 2005, [retrieved on Apr. 12, 2012]. Retrieved from Internet: URL http://www.nature.com/focus/rnai/index.html. 2 pages.
Perriman et al., "Effective ribozyme delivery in plant cells," Proc. Natl. Acad. Sci. USA, Jun. 1995, 92(13):6175-6179.
Perrin et al., "Xyloglucan fucosyltransferase, an enzyme involved in plant cell wall biosynthesis," Science, Jun. 1999, 284:1976-1979.
Rawlings et al., "Evolutionary families of peptidase inhibitors," Biochem J., Mar. 2004, 378(Pt.3):705-16.
Refseth et al., "Hybridization capture of microsatellites directly from genomic DNA," Electrophoresis, 1997, 18: 1519.
Richards et al., "Construction of a GFP-BAR plasmid and its use for switchgrass transformation," Plant Cell. Rep., 2001, 20:48-54.
Riggs et al., "Cotyledon Nuclear Proteins Bind to DNA Fragments Harboring Regulatory Elements of Phytohemagglutinin Genes," The Plant Cell, Jun. 1989, 1(6):609-621.
Rivera et al., "Genomic evidence for two functionally distinct gene classes," Proc. Natl. Acad. Sci. USA, May 1998, 95:6239-6244.
Rosenzweig et al., "Crystal structure of the Atx1 metallochaperone protein at 1.02 A resolution," Structure Fold Des., Jun. 1999, 7:605-617.
Roudier et al., Cobra, an *Arabidopsis* Extracellular Clycosyl-Phosphatidyl Inositol-Anchored Protein, Specifically Controls Highly Anisotropic Expansion through Its Involvement in Cellulose.
Schroder et al., "Biochemical and molecular characterization of xyloglucan endotransglycosylase from ripe kiwifruit," Planta, Feb. 1998, 204:242-251.
Schultz et al., "The classical arabinogalactan protein gene family of *Arabidopsis*," Plant Cell, Sep. 2000, 12:1751-68.
Sheridan et al., "The marl Gene: Controlling the Commitment to the Meiotic Pathway in Maize," Genetics, 1996, 142:1009-1020.
Shibuya et al., "RNA-directed DNA methylation induces transcriptional activation in plants," Proc Natl Acad Sci USA, Feb. 2009, 106(5):1660-1665.
Slocombe et al., "Temporal and Tissue-Specific Regulation of a *Brassica napus* Stearoyl-Acyl Carrier Protein Desaturase Gene," Plant Physiol., 1994, 104(4):167-176.
Somleva et al., "Agrobacterium-Mediated Genetic Transformation of Switchgrass," Crop Sci., 2002, 42:2080-2087.
Sonnhammer et al., "Pfam: A Comprehensive Database of Protein Domain Families Based on Seed Alignments," Proteins, 1997, 28:405-420.
Sonnhammer et al., "Pfam: multiple sequence alignments and HMM-profiles of protein domains," Nucl. Acids Res., 1998, 26:320-322.
Stemple, "Tilling—a high-throughput harvest for functional genomics," Nat Rev Genet, Feb. 2004, 5(2):145-50.
Summerton and Weller, "Morpholino Antisense Oligomers: Design, Preparation, and Properties," Antisense Nucleic Acid Drug Dev., 1997, 7:187-195.
Thomas D. Brock in Biotechnology: A Textbook of Industrial Microbiology, Second Edition (1989). Smauer Associates, Inc., Sunderland, Mass. Too Voluminous to Provide.
Tovkach et al., "A toolbox and procedural notes for characterizing novel zinc finger nucleases for genome editing in plant cells," The Plant Journal, 2009, 57:747-757.
Townsend et al., "High-frequency modification of plant genes using engineered zinc-finger nucleases," Nature, May 2009, 459:442-445.
Truernit et al., The promoter of the *Arabidopsis thaliana* SUC2 sucrose-H+ symporter gene directs expression of B-glucuronidase to the phloem: Evidence for phloem loading and unloading by.
Urao et al, "Molecular cloning and characterization of a gene that encodes a MYC-related protein in *Arabidopsis*," Plant Mol. Biol., 1996, 32:571-57.
Weigel et al., "Activation Tagging in *Arabidopsis*," Plant Physiology, Apr. 2000, 122:1003-1013.
Yamamoto et al., The Promoter of a Pine Photosynthetic Gene Allows Expression of a BGlucuronidase Reporter Gene in Transgenic Rice Plants in a Light-Independent but Tissue-Specific.

(56) References Cited

OTHER PUBLICATIONS

Yan et al., "New Construct Approaches for Efficient Gene Silencing in Plants," Plant Physiol., Aug. 2006, 141:1508-1518.
Zhang et al., "From Laboratory to Field. Using Information from *Arabidopsis* to Engineer Salt, Cold, and Drought Tolerance in Crops," Plant Physiol., Jun. 2004, 135:612-621.
Zheng et al., "SPK1 Is an Essential S-Phase-Specific Gene of *Saccharomyces cerevisiae* That Encodes a Nuclear Serine/Threonine/Tyrosine Kinase," Mol. Cell Biol., Sep. 1993, 13:5829.
GenBank PUZ47563 (2018).
Kondou et al., Plant J 57(5):83-894 (2009).
Waclawovsky, et al.; (2010) Plant Biotech J 8:263-76.
Khanal, et al.; (2007) Biotech Bioeng 98(5):978-85.
Mutwill, et al.; (2008) Curr Opin Plant Biol 11 252-57.
Brady, et al.; (2007) Plant Physiol 143:172-87.
Bode et al., "Refined 1.2 A crystal structure of the complex formed between subtilisin Carlsberg and the inhibitor eglin c. Molecular structure of eglin and its detailed interaction with subtilisin," EMBO J., 1986, 5(4):813-8.
Bustos et al., "Regulation of B-Glucuronidase Expression in Transgenic Tobacco Plants by an A/TRich, cis-Acting Sequence Found Upstream of a French Bean B-Phaseolin Gene," The Plant Cell, 1989, 1(9):839-853.
Cerdan et al., "A 146 bp fragment of the tobacco Lhcbl*2 promoter confers very-low-fluence and high-irradiance responses of phytochrome to a minimal CaMV 35S promoter," Plant Mol. Biol., 1997, 33:245-255.
De Feyter and Gaudron, "Expressing Ribozymes in Plants," Methods in Molecular Biology, 74(43), 1997.
Deshpande MV, "Ethanol production from cellulose by coupled saccharification/fermentation using *Saccharomyces cerevisiae* and cellulose complex from Sclerotium rolfsii UV-8 mutant," Appl. Biochem. Biotechnol., Sep. 1992, 36:227.
Matsuoka et al., "Tissue-specific light-regulated expression directed by the promoter of a C4 gene, maize pyruvate, orthophosphate dikinase, in a C3 plant, rice," Proc. Natl. Acad. Sci. USA, Oct. 1993, 90:9586-9590.
Meier et al., "Elicitor-Inducible and Constitutive in Vivo DNA Footprints Indicate Novel cis-Acting Elements in the Promoter of a Parsley Gene Encoding Pathogenesis-Related Protein 1," The Plant Cell, Mar. 1991, 3:309-316.
Roudier et al., "Cobra, an *Arabidopsis* Extracellular Clycosyl-Phosphatidyl Inositol-Anchored Protein, Specifically Controls Highly Anisotropic Expansion through Its Involvement in Cellulose Microfibril Orientation," The Plant Cell, Jun. 2005, 17(6):1749-63.
Truernit et al., "The promoter of the *Arabidopsis thaliana* SUC2 sucrose-$H_+$ symporter gene directs expression of B-glucuronidase to the phloem: Evidence for phloem loading and unloading by SUC2," Planta, 1995, 196:564-570.
Yamamoto et al., "The Promoter of a Pine Photosynthetic Gene Allows Expression of a BGlucuronidase Reporter Gene in Transgenic Rice Plants in a Light-Independent but Tissue-Specific Manner," Plant Cell Physiol., 1994, 35:773-778.

* cited by examiner

Figure 1

| SEQ_ID_NO | | | | | |
|---|---|---|---|---|---|
| SEQ_ID_NO_483 | MTKQKIVIRV | NLASEKTRSK | AMALVARADG | VSSMGVTGDG | 40 |
| SEQ_ID_NO_485 | MEKQKIVIRL | SVASDKCRSK | AMVLAAKADG | VSKMGITGDG | 39 |
| SEQ_ID_NO_486 | MTKQKIVIKV | SMPCEKSRSK | AMALVARASG | VNSMEVTGDG | 40 |
| SEQ_ID_NO_488 | MAKQKIVIKV | PMASDKSRSK | AMALVAAAGG | VNSVALAGDG | 40 |
| SEQ_ID_NO_490 | MIKQKIVIKV | TVNGPKSRSK | SLQIAVGFSG | VESAGLGGQD | 39 |
| SEQ_ID_NO_492 | MLKQTMVVKV | TMSDEKSRSK | ALKVVVGFSG | VESASLKGDD | 39 |
| SEQ_ID_NO_493 | MFKQKIVMRV | HMRCQKCRTK | ALEVVAGANG | VNFVGLEGDE | 39 |
| SEQ_ID_NO_483 | RDQLEVVGDG | VDTVGLVQCL | RKKIGHAEIL | KVEEVKPAEK | 80 |
| SEQ_ID_NO_485 | KDQLEVEGDG | LDTVCLVNCL | RKKIGRADIV | KVEVVKPEEK | 79 |
| SEQ_ID_NO_486 | KDRLQVVGDG | VDPVCLVACL | RKKIGYAEIV | QVEEVKD--K | 78 |
| SEQ_ID_NO_488 | KDQVVVVGEG | VDSIKLTTIL | RKKMGDAQLV | EVAED---K | 76 |
| SEQ_ID_NO_490 | KSQIEVVGDG | VDAVELTNRL | RKKVGYAEIV | SVAAVG---E | 76 |
| SEQ_ID_NO_492 | KSQIEVTGDG | VDAVQLTSRL | RKSVGHAELV | SVSAVGG--- | 77 |
| SEQ_ID_NO_493 | KDKIVVTGDG | VDAVTLTKCL | RKKVGQTEIV | SLGEVKA--- | 76 |
| SEQ_ID_NO_483 | KPEEKKPEPL | -PDWWWYH- | ---------- | -----PL--- | 104 |
| SEQ_ID_NO_485 | KPEEKKPEVM | PLPYGMCYP- | ---------- | -----PL--- | 105 |
| SEQ_ID_NO_486 | KPEEKKQEPP | -KPVPCYYP- | ---------- | -----PPA-TVV- | 108 |
| SEQ_ID_NO_488 | KKEEKKPDPV | AEAAAYYN- | APPCYY | PPPXAVVYDP | 111 |
| SEQ_ID_NO_490 | KKEEEKPEAM | VQPVLWSMYG | QYYYHY | PL--H--PP- | 110 |
| SEQ_ID_NO_492 | KKEEAKEPPA | AYVWPYN- | QPTY-H | Q--L--P- | 104 |
| SEQ_ID_NO_493 | ---------- | ---------- | QPLYMY | QE------- | 76 |
| SEQ_ID_NO_483 | ---PPPC | M | | | 109 |
| SEQ_ID_NO_485 | CSDEPSPCSI | H | | | 107 |
| SEQ_ID_NO_486 | YPRPGNTCSI | M | | | 119 |
| SEQ_ID_NO_488 | NYYQDPSCSI | M | | | 122 |
| SEQ_ID_NO_490 | YAHQDPCSI | M | | | 121 |
| SEQ_ID_NO_492 | ---------- | M | | | 115 |
| SEQ_ID_NO_493 | ---------- | S | | | 77 |

Figure 2A

| SEQ_ID_NO | | | | | |
|---|---|---|---|---|---|
| SEQ_ID_NO_562 | MAAKKVVLKI | DLHDNKDKQR | VLKAVSTLHG | IDSISVDMKD | 40 |
| SEQ_ID_NO_564 | MEVQKVVLKL | DLHDNKDKQK | VLKAVSTLHG | IDSISVDMKD | 39 |
| SEQ_ID_NO_565 | MAAKKLVLKL | DLHDDKDKQK | VLKAVSTLHG | IDSISVDMKD | 40 |
| SEQ_ID_NO_567 | M-KKVVLKL | DVHDDRHKAK | ALKAVSGLHG | IDQLGVDIKD | 38 |
| SEQ_ID_NO_568 | MAKKVLVLKL | DLHDDKDKQK | AIKAVSTLHG | IDMSMDMKG | 40 |
| SEQ_ID_NO_570 | M--KKFVLKL | DLHDDKDKQK | ALKTVSTLSG | IDAIAMDMKE | 38 |
| SEQ_ID_NO_572 | M--KKTVLKV | DLHDNKDKQK | AMKAVSTLQG | LDSIAMDMKG | 38 |
| SEQ_ID_NO_573 | M--KKAVLKL | DLHDEKAKTK | AMKKVSSLSG | VDSISMDMKD | 38 |
| SEQ_ID_NO_574 | M--KKVILKL | EYFDEKIKQK | AMKKVSGLEG | VESISIDSKD | 38 |
| SEQ_ID_NO_575 | M--KKVILKL | DPRDDKIKQK | AMRTVSGLSG | VDSVAMDMKE | 38 |
| SEQ_ID_NO_576 | M--VLKL | DLHDDRAKQK | ALKTVSTLPG | LDSIAMDMKE | 38 |

| SEQ_ID_NO | | | | | |
|---|---|---|---|---|---|
| SEQ_ID_NO_562 | SKLTVIGLAD | PVDVVAKLRK | VG-AAHILSV | GPAKEEKKDE | 79 |
| SEQ_ID_NO_564 | SKLTVVGLVD | PVDVVAKLRK | VG-AAAIVSV | GPAKEEKKDG | 78 |
| SEQ_ID_NO_565 | NLTVVGLAD | PVDVVARLRK | VA-AAEIVSV | GPAKEDKKEG | 79 |
| SEQ_ID_NO_567 | QKMTIVGTVD | PVAVGKLRK | LFPAVQILSV | GPAKEEKKDD | 78 |
| SEQ_ID_NO_568 | QKLTVVGDVD | PVDVVGKLRK | GMPSASLLSV | GPAKEEKKEE | 80 |
| SEQ_ID_NO_570 | KKLTVIGTVD | PVTVVSKLRK | YW-KADIVAV | GPVKEPEKKE | 77 |
| SEQ_ID_NO_572 | MKMTVIGATD | PIDVVGKLRK | CW-HTDIVSI | GPKEEPKKED | 77 |
| SEQ_ID_NO_573 | KKLTVIGDVD | PVDIVSKLRK | C--NTEIITV | GPVSKLRKED | 77 |
| SEQ_ID_NO_574 | KKLTITGNID | PVSLVSKLRK | LC-HTDIVSV | GPAKEPEKKK | 77 |
| SEQ_ID_NO_575 | KKLTVTGDVD | PVHVVSKLRK | LC-HTDIVSV | GPAKEPEKKA | 77 |
| SEQ_ID_NO_576 | KKLTVIGTVD | PVNVVSKLRK | YWPMTDIVLV | GPAKEPEKEK | 78 |

| SEQ_ID_NO | Sequence | Length |
|---|---|---|
| SEQ_ID_NO_562 | GQYPL-YPYPHPYHYVVHSAEEDPNSCVIC | 135 |
| SEQ_ID_NO_564 | QYHPHPYPPPQYVVHSAEEDPNSCVIC | 141 |
| SEQ_ID_NO_565 | QYHPHPYPPPQYAVHSAEEDPNSCAIC | 137 |
| SEQ_ID_NO_567 | GYPPPPLPPPRYVVHSAEEDPNSCVIC | 147 |
| SEQ_ID_NO_568 | SYSEYPMPPPQYVVHSAEEDPNSCVIC | 137 |
| SEQ_ID_NO_570 | AYNPYLMTTTNYYAPSMEENPNACVIC | 151 |
| SEQ_ID_NO_572 | AYNPG-MTTTHYVQSAEENPNACVIL | 130 |
| SEQ_ID_NO_573 | AYNPHLMTTTYYHVRSVEDDPNACVIS | 132 |
| SEQ_ID_NO_574 | HYQPPVPATTYYHHRSVEEDPNSCVIC | 159 |
| SEQ_ID_NO_575 | AYNPHLMTTTYYYVKSAEEDPNACVIC | 131 |
| SEQ_ID_NO_576 | AYNPHLLTTTYYYAQSTEENPNACVIC | 177 |

Figure 3A

|  |  |  |  |  | |
|---|---|---|---|---|---|
| SEQ_ID_NO_246 | MGLDVGIGM | GLDLGL | FA | ARSAGG--- | 29 |
| SEQ_ID_NO_248 | MGLDVAEIGM | GLDLRL | FA | ARSAVG--- | 29 |
| SEQ_ID_NO_250 | MGLDVGEIGM | GLDLRL | FA | ARTAGG---M | 29 |
| SEQ_ID_NO_251 | MGLDVGEIGM | GLDLKM | FA | ARSAVR---M | 29 |
| SEQ_ID_NO_252 | MGSLSSE--- | --SLDFAR | PSTAKALPFL | PKTIADFLKE | 34 |
| SEQ_ID_NO_254 | MGSVAAE--- | ---ELNLDIRS | SFV | PKTITDFLRH | 28 |
| SEQ_ID_NO_256 | MVQTETDQRM | GLNLNLSLYS | --L | PKPLSQFLDE | 31 |

|  |  |  |  |  | |
|---|---|---|---|---|---|
| SEQ_ID_NO_246 | AA--- | PAEIESCIRS | LEEERRKIEV | FRRELPLCVR | 66 |
| SEQ_ID_NO_248 | AAA--- | PAGIESCIRS | LEEERRKIEV | FRRELPLCVR | 67 |
| SEQ_ID_NO_250 | AAA--- | PAGIEACIRS | LEEERRKIEV | FRRELPLCAR | 67 |
| SEQ_ID_NO_251 | AA--- | AAAKE | LEEERRKIEM | FRRELPLCAR | 66 |
| SEQ_ID_NO_252 | VSVIGDSAVK | ATGVEACIRS | LEEEKRKIDA | FKRELPLSML | 74 |
| SEQ_ID_NO_254 | LIS--ANNH | VLKVDGFIKD | LEDLRKIHA | FKRELPLSML | 65 |
| SEQ_ID_NO_256 | VSRIKDNHSK | PATILRDFLSR | LEEERNKIDV | FKRELPLCML | 71 |

|  |  |  |  |  | |
|---|---|---|---|---|---|
| SEQ_ID_NO_246 | LLADVIDELK | DEAAKRG--- | --- | --- | 83 |
| SEQ_ID_NO_248 | LLADVIEELK | EEAARKG--- | --- | --- | 84 |
| SEQ_ID_NO_250 | LLADVIDELK | EEAAKRG--- | --- | --- | 84 |
| SEQ_ID_NO_251 | LLADVIDELK | EEAGKRR--- | --- | --- | 83 |
| SEQ_ID_NO_252 | LLNDAIELMK | EELMQLG-AS | KNQQPVLEEF | PLKKNIDDH | 113 |
| SEQ_ID_NO_254 | LLNDAISVLK | VESQKCCRVA | RDSPPVLEEF | PLKKELGDQ | 105 |
| SEQ_ID_NO_256 | LLNEAIGALK | DEARKGLSLM | ASN- | --- | 94 |

|  |  |  |  |  | |
|---|---|---|---|---|---|
| SEQ_ID_NO_246 | GDA | EAKADDGDKR | KWMSTAQLWL | DSDAKSDE- | 114 |
| SEQ_ID_NO_248 | GDL | ELRPDDGDKR | KWMSTAQLVW | DSDATSEK- | 114 |
| SEQ_ID_NO_250 | GGDDA | DAKADDGDKR | KWMSTAQLVW | DSEAKSDE- | 116 |
| SEQ_ID_NO_251 | GDDA | EAKAEDGDKT | KWMSSVQLVW | DSRGSDAD- | 117 |
| SEQ_ID_NO_252 | KDGDDA | EEKDSKDKK | NWMSVQLVN | ADDHPSTDY | 149 |
| SEQ_ID_NO_254 | HENDGL | KDDNECRDKR | NWMSSAQLVM | NNTITITIT- | 143 |
| SEQ_ID_NO_256 | GKFDDV | ERAKPEITDKK | SWMSSAQLVM | SNPNSQFR- | 128 |

| | | | | | |
|---|---|---|---|---|---|
| SEQ_ID_NO_246 | KARRCWSPEL | HRLFVAALHQ | LGGPQVATPK | QI REVMKVDG | 249 |
| SEQ_ID_NO_248 | KTRRCWSPEL | HRQFVAALHQ | LGGPQVATPK | QI REVMQVDG | 259 |
| SEQ_ID_NO_250 | KARRCWSPEL | HRQFVAALQQ | LGGPQVATPK | QI REVMQVDG | 252 |
| SEQ_ID_NO_251 | KSRRCWSPEL | HRRFVAALQQ | LGGPQVATPK | QI REVMKVDG | 263 |
| SEQ_ID_NO_252 | KQRRCWSPEL | HRRFVNALQQ | LGGSQAATPK | QI REL MQVDG | 300 |
| SEQ_ID_NO_254 | KQRRCWSPEL | HRRFVNALQK | LGGSQAATPK | QI REL MQVDG | 309 |
| SEQ_ID_NO_256 | EQRRRMSQEL | HRKFVDALHR | LGGPQVATPK | QI RDL MKVDG | 249 |

| | | | | | |
|---|---|---|---|---|---|
| SEQ_ID_NO_246 | LTNDEVKSHL | QKYRLHNRRS | -PGV-VAPVS | QSVML AGGLW | 287 |
| SEQ_ID_NO_248 | LTNDEVKSHL | QKYRLHNRRS | -PGM--APVS | QSI VL VGGLW | 296 |
| SEQ_ID_NO_250 | LTNDEVKSHL | QKYRLHNRRS | -PGV--APVS | QPI ML VGGLW | 289 |
| SEQ_ID_NO_251 | LTNDEVKSHL | QKYRLHNRKS | -PGT--ASAS | HSI VL VGDL W | 300 |
| SEQ_ID_NO_252 | LTNDEVKSHL | QKYRLHTRRV | TPATAAAPAN | QSVVVL GGLW | 340 |
| SEQ_ID_NO_254 | LTNDEVKSHL | QKYRLHTRRV | -PAF--ASSN | QPVVVL GGLW | 345 |
| SEQ_ID_NO_256 | LTNDEVKSHL | QKYRMHTRKH | -PLH--PTKT | LSSSDQPGVL | 286 |

| | | | | | |
|---|---|---|---|---|---|
| SEQ_ID_NO_246 | APPHQ----- | EQSSQSGSP | QGPLQFSGSG | VAL--ATVGG | 319 |
| SEQ_ID_NO_248 | SSQEQ----- | SSSQSQSGSP | QGPLQFSGSG | MAVSAATVGG | 331 |
| SEQ_ID_NO_250 | APQEQ----- | SSSCSQSGSP | QGPLQFSGSG | VAI STATVGG | 320 |
| SEQ_ID_NO_251 | ASQEF----- | VSCSSQSGSP | QGPLQLAVNT | VAVSAATAG | 332 |
| SEQ_ID_NO_252 | MTQDQY-GDSS | KAITSSQSGSP | QGPLQLHLAAGS | G-GTSTTGG | 378 |
| SEQ_ID_NO_254 | MSQDQY-NDSS | KVSSSGSGSP | QGPLVARGLF | RGGTSPIEG | 384 |
| SEQ_ID_NO_256 | ERESQL---S | LILSLSRDSP | QSPLVARGLF | ---SSNVG | 317 |

| | | | | | |
|---|---|---|---|---|---|
| SEQ_ID_NO_246 | DSS------S | SDEDDKS-EG | YSRK------ | ------YV | 338 |
| SEQ_ID_NO_248 | DSS------S | SDEDDKS-DEG | YSRK------ | ------ | 349 |
| SEQ_ID_NO_250 | DSS-G----S | SDEDDKS-EG | YSRK------ | ------ | 341 |
| SEQ_ID_NO_251 | DSC------C | -EDDDKS-EG | YVRK------ | ------CV | 348 |
| SEQ_ID_NO_252 | DSM------E | DDEDAKS-EG | YSWKSHSTRS | G----KDDV | 406 |
| SEQ_ID_NO_254 | DSL------E | DDEDARS-EIS | YSWKSHMNKP | G----KVDV | 412 |
| SEQ_ID_NO_256 | HSSEEDEEEE | DEEEKS-DG | RSSCRNDETK | KKRQVLDLEL | 356 |

Figure 4

| SEQ_ID_NO | | | | | | 33 |
|---|---|---|---|---|---|---|
| SEQ_ID_NO_111 | MAR--TTP-F | GL---AVAAA | LVFAVAMPAL | ---AAAQAPAPA | 33 |
| SEQ_ID_NO_113 | MAR--TPL-L | GL---AIAAA | LVFAVAMPAV | ---ADAQAPAPA | 33 |
| SEQ_ID_NO_115 | MAR--TL--F | GF---VVAAA | LVLAVEMPAL | ---AAAQAPAPA | 32 |
| SEQ_ID_NO_117 | MAVARAP--L | GAVA-MAVAA | LVFAI LMPAA | ---AAAQAPAPS | 36 |
| SEQ_ID_NO_118 | MAR--IPL-F | AA---LVVAL | LSFAI A--- | GAQSLAPAPA | 28 |
| SEQ_ID_NO_120 | MAS--RNSMT | GF---ALFS | FVFAVI LSLA | ---AAQSLAPAPA | 34 |
| SEQ_ID_NO_122 | MAA--IPL-K | VL---VAVLV | LALATVVPSE | -VQAQAPAPS | 31 |
| SEQ_ID_NO_124 | MAV--CASFK | AFIAVLAVVS | LILAVVSPSV | EAQSPIAPAPA | 38 |

| SEQ_ID_NO | | | | | | 72 |
|---|---|---|---|---|---|---|
| SEQ_ID_NO_111 | PTSDGTSI DQ | GI AYLLMI VA | LVLTYLI HPL | DASSPYKLF | 72 |
| SEQ_ID_NO_113 | PTSDGTSI DQ | GI AYLLMI VA | LVLTYLI HPL | DASSPYRLF | 72 |
| SEQ_ID_NO_115 | PTSDASSVDQ | GI AYLLMI LA | LVLTYLI HPL | DASSPYKLF | 71 |
| SEQ_ID_NO_117 | PTSDGTSI DL | GVAYFLMI LA | LVLTYLI HPL | DASSPYKLF | 75 |
| SEQ_ID_NO_118 | PTSDGTSVDQ | GI AYFLML VA | LVLTYLI HPL | DASSAYKLF | 67 |
| SEQ_ID_NO_120 | PTSDGTSI DQ | GI AYLLMVVA | LVLTYLI HPL | DASSSYSF | 73 |
| SEQ_ID_NO_122 | PTSDGTSI DQ | GI AYLLMI VA | LVLTYLI HPL | DASFPYKLF | 69 |
| SEQ_ID_NO_124 | PTSDGTSI DQ | GI AYLLMI VA | LVLTYLI HPL | DASSFYTFF | 76 |

| SEQ ID | Segment 1 | Segment 2 | Segment 3 | Segment 4 | Pos |
|---|---|---|---|---|---|
| SEQ_ID_NO_348 | KRVHISLDER | TGAGFASQGA | YLHGLFSARI | KLPANHTASV | 98 |
| SEQ_ID_NO_350 | KRVHISLDER | TGAGFASQGA | YLHGSFSARI | KLPADHTAGV | 100 |
| SEQ_ID_NO_351 | KRVHISLDER | TGAGFASQGA | YHHGFFSASI | KLPADHTAGV | 106 |
| SEQ_ID_NO_353 | KRVHISLDER | TGSGFVSQDL | YLHGFFSASI | KLPSDYAGV | 97 |
| SEQ_ID_NO_355 | KRVHLSLDER | TGSGFVSQDL | YLHGYFSASI | KLPADYTAGV | 95 |
| SEQ_ID_NO_357 | KAVHLSLNER | TGSGFVSQDL | YLHGYFSASI | KLPADYTAGV | 89 |
| SEQ_ID_NO_359 | KSVHLSLDER | TGSGFISQDL | YLHGFFSSSI | KLPADYSAGV | 94 |
| SEQ_ID_NO_360 | ETVHMSLDER | TGSGFVSHDL | YLHGFFSASI | KLPADYTAGV | 89 |
| SEQ_ID_NO_361 | KSVRLTLDER | TGSGFVSHDL | YKHGFFSASI | KLPADYTAGV | 90 |
| SEQ_ID_NO_362 | KSAHLSLDER | TGSGFVSHDL | YLHGLFSASI | KLPEDYTAGV | 89 |
| SEQ_ID_NO_363 | KSVHISLDKR | TGAGFVSHDL | YMYGLFSASI | KLPDDYTAGV | 73 |
| SEQ_ID_NO_364 | KAVMLSLDER | TGSGLLSQDM | YMYGLFSASI | KLPDDYTAGV | 105 |

| SEQ ID | Segment 1 | Segment 2 | Segment 3 | Segment 4 | Pos |
|---|---|---|---|---|---|
| SEQ_ID_NO_348 | VVAFYMSNGD | VYERTHDELD | FEFLGNVRGR | EWRVQTNVYG | 138 |
| SEQ_ID_NO_350 | VVAFYMSNGD | VYERTHDELD | FEFLGNVRGR | EWRVQTNVYG | 140 |
| SEQ_ID_NO_351 | VVAFYMSNGD | VYERTHDELD | FEFLGNVRGR | EWRVQTNVYG | 146 |
| SEQ_ID_NO_353 | VVAFYMSNGD | VYEKTHDELD | FEFLGNVKGK | DWRIQTNIYG | 137 |
| SEQ_ID_NO_355 | VVAFYMSNGD | MFEKNHDEID | FEFLGNIRGK | DWRIQTNVYG | 135 |
| SEQ_ID_NO_357 | VVAFYMSNGE | MFEANHDEID | FEFLGNIRGK | DWRIQTNIYG | 129 |
| SEQ_ID_NO_359 | VVAFYMSNAD | MFQNNHDEID | FEFLGNIRGK | DWRIQTNVYG | 134 |
| SEQ_ID_NO_360 | VIAFYLSNGD | LYEKNHDEID | FEFLGNIRGR | EWRLQTNIYG | 129 |
| SEQ_ID_NO_361 | VVAFYMSNGD | MFAKNHDEID | FEFLGNIRAK | NWRIQTNVYG | 130 |
| SEQ_ID_NO_362 | VVAFYMSNVD | MFEKNHDEID | FEFLGNIRGK | EWRIQTNVYG | 129 |
| SEQ_ID_NO_363 | VVAFYMSNGD | LFQGTHDELD | FEFLGNIRGK | EWRIQTNIYG | 113 |
| SEQ_ID_NO_364 | VVAFYTSNGD | LFQGTHDELD | FEFLGNIRGK | EWRIQTNVYG | 145 |

Figure 5C

| SEQ_ID_NO | Sequence | | | | # |
|---|---|---|---|---|---|
| SEQ_ID_NO_348 | NGNTAAGREE | RYGLWFDPTE | DFHRYAILWS | RDRIIFYVDE | 178 |
| SEQ_ID_NO_350 | NGSTAVGREE | RYGLWFDPTE | DFHRYAILWS | RHRIIFYVDD | 180 |
| SEQ_ID_NO_351 | NGSTAAGREE | RYGLWFDPTQ | DFHRYAILWS | HDTIIFYVDE | 186 |
| SEQ_ID_NO_353 | DGSTAVGREE | RYGLWFDPTE | DFHRYAILWT | NRTIVFYVDG | 177 |
| SEQ_ID_NO_355 | NGSTSAGREE | RYSLWFDPSD | DFHQYSILWT | NSQIIFYVDN | 175 |
| SEQ_ID_NO_357 | NGSTSVGREE | RYNLWFDPAD | DFHQYSILWT | DSQIIFYIDN | 169 |
| SEQ_ID_NO_359 | NGSTSIGREE | RYGLWFDPAE | DFHQYSILWS | DSKIIFYVDN | 174 |
| SEQ_ID_NO_360 | NGSTNVGREE | RYGLWFDPSE | DFHQYSILWS | DNLIFYVDN | 169 |
| SEQ_ID_NO_361 | NGSTHLGREE | RYHLWFDPTE | DFHQYSILWS | LSHIIFYVDN | 170 |
| SEQ_ID_NO_362 | NGSTGAGREE | RYNLWFDPSD | DFHQYTILWT | KDRIIFYIDN | 169 |
| SEQ_ID_NO_363 | NGSTNVGGEE | RYGLWFDPTE | DFHTYTILWT | DSHIFYVDN | 153 |
| SEQ_ID_NO_364 | NGSTAFGREE | RYTLWFDPTE | DFHQYTILWT | DKRTLFVDD | 185 |

| SEQ_ID_NO | Sequence | | | | # |
|---|---|---|---|---|---|
| SEQ_ID_NO_348 | TPIREVVRTE | SMGAQFPSKP | MSLYATIVDG | SSWATSGGRY | 218 |
| SEQ_ID_NO_350 | TPIREVVRTE | AMGAQFPSKP | MSLYATIVDG | SWATSGGRY | 220 |
| SEQ_ID_NO_351 | TPIREVVRTE | SMGAQFPSKP | MSLYATIVDG | SWATSGGRY | 226 |
| SEQ_ID_NO_353 | TPIREVVRSE | AMGADFPSKP | MSLYATIVDG | SDWATNGGRY | 217 |
| SEQ_ID_NO_355 | LPIREVKRTE | SMGAXFPSKP | MSLYATIVDG | SDWATNGGKY | 215 |
| SEQ_ID_NO_357 | VPIREFKRTA | AMGGDFPSKP | MTMYATIVDG | SEWATNGGKY | 209 |
| SEQ_ID_NO_359 | VPIREVKRTE | SMGGDFPSKP | MSLYASTIVDG | SDWATDGGKY | 214 |
| SEQ_ID_NO_360 | VPIREIKRTA | AMGGDFPAKP | MSLYATIVDG | SEWATNGGKY | 209 |
| SEQ_ID_NO_361 | VPIREVKRTE | SMGGDFPSKP | MSLYATIVDA | KWATNGGKY | 210 |
| SEQ_ID_NO_362 | VPIREVKKTE | AMGGDFPSKP | MSLYGTIVDG | NWATNGGKY | 209 |
| SEQ_ID_NO_363 | VPIREIKRTQ | AMSEDFPSKP | MSLYGTIVDG | SWATNGGKY | 193 |
| SEQ_ID_NO_364 | VPIREIKRTA | AMGAHYPSKP | MSVYATVWDG | SDVATKGGRY | 225 |

Figure 5D

Left block:

| SEQ ID NO | Start |  |  |  |  |  |  |
|---|---|---|---|---|---|---|---|
| SEQ_ID_NO_348 | 250 | KVDYKYAPYV | AEFADLALRG | --- | CAVG- | GR--- | ACEEPG- |
| SEQ_ID_NO_350 | 255 | KVDYKYAPYV | AEFADLALRG | --- | CAVG- | ----- | AATPG- |
| SEQ_ID_NO_351 | 259 | KVNYKYAPYV | AEFTDLLLHG | --- | CPAGS | PASAS | PCEGAA- |
| SEQ_ID_NO_353 | 248 | KVDYKYAPYV | AEFTDLVLHG | A-- | CDQ-- | PP--- | ACEPEG- |
| SEQ_ID_NO_355 | 251 | RVNYKYAPYV | AEFSDLVLHG | --- | CAVD- | PA--- | PRCDNTE- |
| SEQ_ID_NO_357 | 246 | RVNYKYAPYV | AEFSDLILHG | SQ- | CAVD- | PVEQF | SKKCDTTS- |
| SEQ_ID_NO_359 | 250 | RVNYKYAPYV | AEFSDLILHG | SL- | CAVD- | PIEFS | AKCESAQ- |
| SEQ_ID_NO_360 | 246 | GVNYKYAPYI | SQFTDLILHG | Q-- | CAVD- | PIEHV | PKCDNGPT |
| SEQ_ID_NO_361 | 247 | KVNYKYAPYV | AEFSDFVLHG | SE- | CAVD- | PIEKS | PSCKDEAV |
| SEQ_ID_NO_362 | 245 | KVNYKYAPYV | AKFSDFVLHG | K-- | CAVD- | PTEKF | TSCDTAP- |
| SEQ_ID_NO_363 | 229 | KVNYKYSPYI | SQFSNLVLEG | D-- | CGVD- | PIEMS | PKCDIVL- |
| SEQ_ID_NO_364 | 263 | RVNYKYSPFV | VSLSNLVLEG | TSS | CAVD- | PLEQF | HTVSCPADT |

Right block:

| SEQ ID NO | Start |  |  |  |  |  |
|---|---|---|---|---|---|---|
| SEQ_ID_NO_348 | 282 | G-- | TAAPAMSPAQ | RSAMEAFRAQ | HMTYGYCYDR |
| SEQ_ID_NO_350 | 295 | SASDDDDAYG | RAADAISPAR | RSAMEAFRAR | YMTYGYCYDR |
| SEQ_ID_NO_351 | 288 | A-- | -SATMPPGQ | RSAMERFRAR | HMTYGYCYDR |
| SEQ_ID_NO_353 | 276 | --- | GSAMPSRQ | RAAMERVRAR | HMTYGYCYDR |
| SEQ_ID_NO_355 | 284 | SL- | AIPTGVTPVQ | RTKMESFRAK | FMTYSYCYDQ |
| SEQ_ID_NO_357 | 279 | SQ- | ELSATITPSQ | RSKMDSFRRK | HMTYSYCYDR |
| SEQ_ID_NO_359 | 283 | SL- | KVPSGVTPVQ | ITKMRNFRLK | HMAYSYCYDT |
| SEQ_ID_NO_360 | 279 | G-- | SIPTGI MPEQ | RSKMEKFRKT | HMTYSYCYDR |
| SEQ_ID_NO_361 | 280 | KA- | RLASEITESQ | RNKMELFRQK | HMTYSYCYDH |
| SEQ_ID_NO_362 | 278 | SQ- | SVPTGTTKES | RTKMQNLRKK | YMQYSYCYDT |
| SEQ_ID_NO_363 | 262 | D-- | SIPTRISPDQ | RRKMERFRNK | YLQYSYCYDR |
| SEQ_ID_NO_364 | 299 | DSL | SQFSELSEDQ | KALMEWFRSK | YISYSYCDDD |

Figure 5 E

| SEQ ID | Col1 | Col2 | Col3 | Col4 | Col5 | Pos |
|---|---|---|---|---|---|---|
| SEQ_ID_NO_348 | LRYPAPLPEC | SVGPEAAAFL | PSGDALRAAL | R---RRGR | 316 |
| SEQ_ID_NO_350 | LRYPAPLPEC | SVGAEAAAFL | PSGDARA-AL | H---RHGR | 329 |
| SEQ_ID_NO_351 | VRYHAPLPEC | SVGAEAEAFL | PSGEARS-TD | RRGGRHGK | 325 |
| SEQ_ID_NO_353 | ARYQAPLPEC | RVGAEAAMYL | PSGEARS-SD | RRL--RHGK | 311 |
| SEQ_ID_NO_355 | VRYRAPPSEC | VINTKEADRL | KSYDPVTFGG | GRR--HHGK | 321 |
| SEQ_ID_NO_357 | TRYKVPPPEC | VINPREAERL | KRFDPVTFGG | -RR--HHGK | 315 |
| SEQ_ID_NO_359 | VRYKVPPPEC | VINHQEAERL | RKFDPVTFGG | GQR--HRGK | 320 |
| SEQ_ID_NO_360 | MRYKVVLSEC | VVNAQEAKRL | RRFDPVTFGG | RRHH--HHGK | 317 |
| SEQ_ID_NO_361 | TRYQVPPSEC | VVNPAEAKRL | RVYDPVTFGG | IPH--GHRR | 317 |
| SEQ_ID_NO_362 | TRYNVPQSEC | VIDPLESERL | RGFDPVTFGT | SHR--GHGK | 315 |
| SEQ_ID_NO_363 | VRYPTTPADC | VIDPKEANRL | RGFDPMTFGG | VPR--HQNK | 299 |
| SEQ_ID_NO_364 | PPRDP-HKKI | ATAHV-RFGH | HQRHRKKNRK | | 337 |

| SEQ ID | Col1 | Col2 | Col3 | Col4 | Pos |
|---|---|---|---|---|---|
| SEQ_ID_NO_348 | RH- | QT- | -- | -- | RG | AV | 328 |
| SEQ_ID_NO_350 | RN- | RM- | G-- | AL- | RR | AV | 341 |
| SEQ_ID_NO_351 | RH- | RR- | G-- | V-- | AG | AL | 338 |
| SEQ_ID_NO_353 | RH- | RRL | GG- | A-- | AG | SL | 323 |
| SEQ_ID_NO_355 | RH- | HHSRSSH | A-- | E-- | SH | SI- | 336 |
| SEQ_ID_NO_357 | RH- | HRSRASR | A-- | E-- | S-- | TI- | 330 |
| SEQ_ID_NO_359 | RHX | HSSKGSQ | S-- | E-- | EL- | SF- | 338 |
| SEQ_ID_NO_360 | RH- | QRNRSSQ | EL- | TAS | GL- | TT- | 332 |
| SEQ_ID_NO_361 | GK- | HRSRSRL | G-- | AT- | R-- | SI- | 332 |
| SEQ_ID_NO_362 | RH- | HNRRSYR | H-- | TE- | G-- | SV- | 330 |
| SEQ_ID_NO_363 | RH- | HQRQSRR | E-- | IN- | D-- | AK- | 314 |
| SEQ_ID_NO_364 | SH- | RSF--SS | GAAA | V-V | AAA | SL- | 352 |

Figure 6A

| SEQ_ID_NO_774 | M- | GSMEGLS | RTVIH- | FLLL | FCLVCKCLAS | - - - - | D- LEAT | 32 |
|---|---|---|---|---|---|---|---|---|
| SEQ_ID_NO_775 | M- | ASRESFM | STIFF- | FLLL | FSLGCKCIAS | - - - - | ELHLHAT | 34 |
| SEQ_ID_NO_776 | M- | GSRQVFV | PTIACL- | VLLL | FCFGCKCIAS | - - - - | ELLQAT | 32 |
| SEQ_ID_NO_777 | M- | GSCKSPH | VVLL | HVL | LCSVYRCFAI | - - - - | G-VDAN | 31 |
| SEQ_ID_NO_778 | M- | GSCKSPH | LVLL- | YVL | LCSVYRCFAI | - - - - | G-VDAN | 31 |
| SEQ_ID_NO_780 | M- | GSSKALC | SVSLLH- | FIV | VCLVFQCFAT | - - - - | K-NHAD | 33 |
| SEQ_ID_NO_781 | M- | GSCKSPH | LVLL- | YVL | LCSVYRCFAI | - - - - | G-VDAN | 31 |
| SEQ_ID_NO_782 | M- | GSRKSPH | VVLL- | YVL | LCFVYQSFAI | - - - - | G-VDTN | 31 |
| SEQ_ID_NO_783 | M- | GVLDV- | -L | CCC | CCLVLPCFAV | - - - - | - -EA | 23 |
| SEQ_ID_NO_785 | M- | GYWKASC | SVLLVCF- | FVG | LCSVYQCSAA | - - - - | E-VDAY | 33 |
| SEQ_ID_NO_786 | M- | ESRHSIH | HVLLL- | VLFG | LSALCQCSAT | - - - - | G-VEAN | 32 |
| SEQ_ID_NO_788 | MDMESWKLLR | SVCVLSFLLG | FFL | SCFVYQSLRV | VDAQ- | - EDPK | 38 |
| SEQ_ID_NO_789 | M- | GCFRASC | KVLFC- | EFFL | VSSYQFLPLI | - - - - | G-ADGN | 32 |

| SEQ_ID_NO_774 | QKATLKIDAS | PKLARKIPDT | LLGVFFKEMG | RGGAGGLWAE | 72 |
|---|---|---|---|---|---|
| SEQ_ID_NO_775 | QTAVLKVDAS | PQLARQIPDT | LFGIFFEEIN | HAGAGGIWAE | 74 |
| SEQ_ID_NO_776 | QTATLKVDAS | SQLARKIPDT | LFGIFFEEIN | HAGAGGIWAE | 72 |
| SEQ_ID_NO_777 | QTANLLIDAS | QASARPISDT | LFGMFFEEIN | HAGAGGVWAE | 71 |
| SEQ_ID_NO_778 | QTANLLIDAS | QASARPIPET | LFGIFFEEIN | HAGAGGVWAE | 71 |
| SEQ_ID_NO_780 | QTANLLTTNAS | DASGKPISDT | LFGIFFEEIN | HAGAGGLWAE | 73 |
| SEQ_ID_NO_781 | QTANLLIDAS | QASARPISET | LFGIFFEEIN | HAGAGGIWAE | 71 |
| SEQ_ID_NO_782 | QTAKLLVDAS | EASGRPIPET | LFGIFFEEIN | HAGAGGIWAE | 71 |
| SEQ_ID_NO_783 | QTAQLIVNAS | QASGRPISPTT | LFGIFFEEIN | HAGAGGLWAE | 63 |
| SEQ_ID_NO_785 | QTAKLIVNAS | - -SGRPIPET | LFGIFFEEIN | HAGAGGLWAE | 71 |
| SEQ_ID_NO_786 | QTAVLLVNAS | EASARRIPDT | LFGIFFEEIN | HAGAGGLWAE | 72 |
| SEQ_ID_NO_788 | PAVITLQVDAS | NGGGRPIPET | LFGLFFEEIN | HAGAGGLWAE | 78 |
| SEQ_ID_NO_789 | QTAQLIVDIT | -KGPGRKMPET | LFGLFFEEIN | HAGAGGLWAE | 71 |

Figure 6B

| SEQ ID NO | | | | | | |
|---|---|---|---|---|---|---|
| SEQ_ID_NO_774 | LVSNRGFEAG | GPNTPSNI DP | WLI GNESSI | FVETDRTSCF | 112 |
| SEQ_ID_NO_775 | LVSNRGFEAG | GPHTPSNI DP | WSI I GDDSSI | FVATDRTSCF | 114 |
| SEQ_ID_NO_776 | LVSNRGFEAG | GLHTPSNI DP | WSI I GDDSSI | FVATDRTSCF | 112 |
| SEQ_ID_NO_777 | LVSNRGFEAG | GPNTPSNI DP | WSI I GNESSL | IVSTDRTSCF | 111 |
| SEQ_ID_NO_778 | LVSNRGFEAG | GPNTPSNI DP | WAI I GNESFL | LVSTDRSSCF | 111 |
| SEQ_ID_NO_780 | LVSNRGFEAG | GPNTPSNI DP | WSI I GNESLI | NVETDRSSCF | 113 |
| SEQ_ID_NO_781 | LVSNRGFEAG | GPNTPSNI DP | WAI I GNESFL | TVSTDRSSCF | 111 |
| SEQ_ID_NO_782 | LVSNRGFEAG | GPNTPSNI DP | WSI I GSESSL | IVSTDRSSCF | 111 |
| SEQ_ID_NO_783 | LVSNRGFEAG | GPNTPSNI DP | WSI I GDQSSL | LVSTDRSSCF | 103 |
| SEQ_ID_NO_785 | LVSNRGFEAG | GPNVPSNI AP | WSI I GDESKV | TVSTDRSSCF | 111 |
| SEQ_ID_NO_786 | LVNNRGFEAG | GQNTPSNI MP | WSI VGDHISI | LVATDRSSCF | 112 |
| SEQ_ID_NO_788 | LVSNRGFEAG | GQNVPSNI DP | WSI I GDESKV | YVATDRSSCF | 118 |
| SEQ_ID_NO_789 | LVSNRGFEEGG | GPTTPSNI DP | WAVI GNESYV | VVATDRSSPF | 111 |

| SEQ ID NO | | | | | | |
|---|---|---|---|---|---|---|
| SEQ_ID_NO_774 | SRNI VALRME | VLC--NN--- | ------ | CPAGGVGI | YNPGFWGMNI | 145 |
| SEQ_ID_NO_775 | SRNTVALRME | VLC--DN--- | ------ | CPAGGVGI | YNPGFWGMNI | 147 |
| SEQ_ID_NO_776 | SRNI ALRME | VLC--DD--- | NSCPASGVGI | YNPGFWGMNI | 145 |
| SEQ_ID_NO_777 | DRNKVALRME | VLC--DTQGA | NI CPAGGVGI | YNPGFWGMNI | 149 |
| SEQ_ID_NO_778 | DRNKVALRLE | VSC--DSEGD | NSCPADGVGI | YNPGFWGMNI | 149 |
| SEQ_ID_NO_780 | DRNKVALRI E | VLC--DTQGA | SSCPAGGVGI | YNPGFWGMNI | 151 |
| SEQ_ID_NO_781 | DRNKVALRME | VLC--DSQGA | NI CPAGGVGI | YNPGFWGMNI | 149 |
| SEQ_ID_NO_782 | ERNKVALRI E | VLC--DSEGS | NI CPDGGVGI | YNPGFWGMNI | 149 |
| SEQ_ID_NO_783 | ERNKVALRMH | VLC--DHTGA | NI CPAGGVGI | YNPGFWGMNI | 141 |
| SEQ_ID_NO_785 | DRNKI AVQVQ | VLC--DSKG- | -CPSGGVGV | YNPGYWGMNV | 149 |
| SEQ_ID_NO_786 | EERNKI ALRMD | VLC--DSKG- | -CPSGGVGV | YNPGYWGMNV | 150 |
| SEQ_ID_NO_788 | ERNKVALRVE | VLCGNDDSNST | NTCPAGGVGV | YNPGYWGMNV | 153 |
| SEQ_ID_NO_789 | ERNKVALRVE | VLCGNDDSNST | NTCPAGGVGV | YNPGYWGMNV | 151 |

| SEQ_ID_NO | | | | | | |
|---|---|---|---|---|---|---|
| SEQ_ID_NO_774 | VSLMPADTYK | GHGFRDELVS | MLLDLKPQFL | RFPGGCFVQG | 263 |
| SEQ_ID_NO_775 | VSLMPADTYK | GHGFRTELIS | MMLDLKPRFL | RFPGGCFVEG | 265 |
| SEQ_ID_NO_776 | VSLMPSDTFK | GHGFRTELIS | MLLDLKPRFF | RFPGGCFVEG | 263 |
| SEQ_ID_NO_777 | VSAIPLDTYK | GHGFRKDLVQ | MLADLKPRFF | RFPGGCFVEG | 269 |
| SEQ_ID_NO_778 | VSAIPLDTYK | GHGFRKDLVQ | MLADLKPRFI | RFPGGCFVEG | 269 |
| SEQ_ID_NO_780 | VSAMPLDTYK | GHGFRTDLVE | MLTALKPRFI | RFPGGCFVEG | 271 |
| SEQ_ID_NO_781 | VSAIPLDTYK | GHGFRKDLVQ | MLAFKPRFI | RFPGGCFVEG | 269 |
| SEQ_ID_NO_782 | VMPLDTYK | GHGFRKDLVE | MLEDLKPQFL | RFPGGCFVEG | 269 |
| SEQ_ID_NO_783 | VSAMPLDTYK | GHGFRKDLVD | MLADMKPQFI | RFPGGCFVEG | 261 |
| SEQ_ID_NO_785 | VSAMPLETYK | GHGFQKELIE | MLEDIKPQFI | RFPGGCFVEG | 267 |
| SEQ_ID_NO_786 | VSLMPTDTHK | GHGFRNDLFQ | MLKDLKPIAFI | RFPGGCFVEG | 268 |
| SEQ_ID_NO_788 | VSAMPVDTHK | NHNFRKDLSQ | MMADIKPRFL | RFPGGCFVEG | 273 |
| SEQ_ID_NO_789 | VSLMPVDTYR | GHGFRKDLVE | MIADLKPRFL | RFPGGCFVEG | 271 |

| SEQ_ID_NO | | | | | | |
|---|---|---|---|---|---|---|
| SEQ_ID_NO_774 | GWLRNAFRWR | ESIGPWEERP | GHFGDCWNYW | TDDGLGYFEF | 303 |
| SEQ_ID_NO_775 | EWLRNAFRWR | ESIGPWEERP | GHFGDVWHYW | TDDGLGYYEF | 305 |
| SEQ_ID_NO_776 | EWLRNAFRWK | ESIGPWEERP | GHFGDVWHYW | TDDGLGYFEF | 303 |
| SEQ_ID_NO_777 | EWLRNAFRWK | ETIGPWEERP | GHFGDVWMYW | TDDGLGYYEF | 309 |
| SEQ_ID_NO_778 | EWLRNAFRWK | ETIGPWEERP | GHFGDVWMYW | TDDGLGYYEF | 309 |
| SEQ_ID_NO_780 | EWLRNAFRWK | TSIGPWEERP | GHFGDVWMYW | TDDGLGYYEF | 311 |
| SEQ_ID_NO_781 | EWLRNAFRWK | ETIGPWEERP | GHFGDVWMYW | TDDGLGYFEF | 309 |
| SEQ_ID_NO_782 | EWLRNAFRWK | ETIGPWEERP | GHFGDVWMYW | TDDGLGYFEF | 309 |
| SEQ_ID_NO_783 | EWLRNAFRWK | ESIGQWEERP | GHFGDVWMYW | TDDGIGYFEF | 301 |
| SEQ_ID_NO_785 | EWLRNAFRWK | ETIGQWEERP | GHFGDVWKYW | TDDGLGHFEF | 307 |
| SEQ_ID_NO_786 | DWLRNAFRWK | ETVGPWEERP | GHFGDVWKYW | TDDGLGHFEF | 308 |
| SEQ_ID_NO_788 | EWLSNAFRWK | QTIGPWEERP | GHFGDVWKYW | TDDGLGYFEF | 313 |
| SEQ_ID_NO_789 | DWLRNAFRWK | ETIGPWEERP | GHFGDVWKYW | TDDGLGYFEF | 311 |

| SEQ_ID_NO | | | | | |
|---|---|---|---|---|---|
| SEQ_ID_NO_774 | 423 | FYNGNYLKFY | NAIREAYPDI | QLISNCDGSS | GPLDHPADLY |
| SEQ_ID_NO_775 | 425 | FYRGNYLKFY | NAIREAYPDI | QMISNCDASS | SPLDHPADLY |
| SEQ_ID_NO_776 | 423 | YYLGNYLKFY | NAIRESYPDI | QMISNCDGSS | KPLDHPADMY |
| SEQ_ID_NO_777 | 429 | NYRGNYLKFF | SAIRNAYPDI | KMISNCDGSS | RQLDHPADMY |
| SEQ_ID_NO_778 | 429 | NYRGNYLKFY | SAIRNAYPDI | KMISNCDGSS | RPLDHPADLY |
| SEQ_ID_NO_780 | 431 | NYRGNYLKFY | SAIKSAYPDI | QIISNCDGSS | RQLDHPADMY |
| SEQ_ID_NO_781 | 429 | NYRGNYLKFY | SAIRNAYPDI | KMISNCDGSS | RQLDHPADLY |
| SEQ_ID_NO_782 | 429 | NYRGNYLKFY | SAIKRAYPDI | KIISNCDGSS | RKLDHPADLY |
| SEQ_ID_NO_783 | 421 | NYRGNYLKFY | DAIKSAYPDI | KIISNCDGSS | HPLDHPADLY |
| SEQ_ID_NO_785 | 427 | QYRGNYLKFY | TAIKDKYPDI | KIISNCDGSS | HSLDHPADYY |
| SEQ_ID_NO_786 | 428 | YYRGNYIVFY | DAIKKAYPDI | KIISNCDGST | RPLDHPADYY |
| SEQ_ID_NO_788 | 433 | NYRGNYMRFY | DAIKRVYPDI | KLITNCDASS | RKLNHPADYY |
| SEQ_ID_NO_789 | 431 | | | | |

| SEQ_ID_NO | | | | | |
|---|---|---|---|---|---|
| SEQ_ID_NO_774 | 463 | DFHVYADAKT | LFSMKNTFDK | TSRSGPKAFV | SEYAVWKITDA |
| SEQ_ID_NO_775 | 465 | DFHVYTDSKT | LFSMKNTFDR | SSRNGPKAFV | SEYAVWRSDA |
| SEQ_ID_NO_776 | 463 | DFHVYTDSKT | LFNMKGTFDK | TSRTGPKAFV | SEYAVWRTDA |
| SEQ_ID_NO_777 | 469 | DFHVYTSASN | LFSMANHFDH | TSRNGPKAFV | SEYAVTGKDA |
| SEQ_ID_NO_778 | 469 | DFHVYTSASN | LFSMANHFDH | TSRNGPKAFV | SEYAVTGKDA |
| SEQ_ID_NO_780 | 471 | DYHVYTSASN | LFSMANHFDH | TSRNGPKAFV | SEYAVTGKDA |
| SEQ_ID_NO_781 | 469 | DFHIYTSASN | LFSMANHFDH | TSRSGPKAFV | SEYAVTGKDA |
| SEQ_ID_NO_782 | 469 | DFHVYTDAKN | MFYRANTFDH | TPRKGPKAFV | SEYAVTGKDA |
| SEQ_ID_NO_783 | 461 | DFHIYTSASH | LFSMTHQFDH | TSRSGPKAFV | SEYAVTGKDA |
| SEQ_ID_NO_785 | 467 | DFHIYSSASS | VFSNARHFDS | APRRGPKAFV | SEYAVTGNDA |
| SEQ_ID_NO_786 | 468 | DYHIYTSASN | LFSMYHQFDR | TSRKGPKAFV | SEYAVTGKDA |
| SEQ_ID_NO_788 | 473 | DFHIYTSATN | LYSMAHQFDR | TSRDAPKAFV | SEYAVTGKDA |
| SEQ_ID_NO_789 | 471 | | | | |

Figure 6G

| SEQ ID NO | | | | | | |
|---|---|---|---|---|---|---|
| SEQ_ID_NO_774 | GRGTLLASLA | EAAFLTGLEK | NSDVVEMACH | APLFVNDDIE | 503 |
| SEQ_ID_NO_775 | GRGSLLASLA | EAAFLTGLEK | NSDVVQMASY | APLFVNDNND | 504 |
| SEQ_ID_NO_776 | GRGSLLGSLA | EAAFLTGLEK | NSDIVHMASY | APLFVNDNDD | 502 |
| SEQ_ID_NO_777 | GRGSLLAALA | EAGFLIGLEK | NSDIVEMASY | APLFVNTHDD | 508 |
| SEQ_ID_NO_778 | GRGSLLAALA | EAGFLIGLEK | NSDIVEMASY | APLFVNTHDD | 508 |
| SEQ_ID_NO_780 | GRGSLLAALA | EAGFLIGLEK | NSDIVQMASY | APLFVNANDD | 510 |
| SEQ_ID_NO_781 | GRGSLLAALA | EAGFLIGLEK | NSDIVESGHL | RPLPL-RQHN | 507 |
| SEQ_ID_NO_782 | GRGSLLAALG | EAGFLIGLEK | NSDVVEMASY | APLFVNANDD | 508 |
| SEQ_ID_NO_783 | GTGSLLAALA | EAGFLIGLEK | NSDVVEMASY | APLFVNANDN | 500 |
| SEQ_ID_NO_785 | GTGSLLAALG | EAAFLIGVEK | NSEAIEMASY | APLFVNDNDD | 506 |
| SEQ_ID_NO_786 | GTGSLLASLA | EAAFLIGLEK | NSDIVEMASY | APLFVNTNDD | 507 |
| SEQ_ID_NO_788 | GKGSLLAALA | EAAFLIGLEK | NSDVVEMASY | APLFVNDNDD | 512 |
| SEQ_ID_NO_789 | GSGTLLAALA | EAAFLIGVEK | NSDVVEMASY | APLFVNSNLD | 510 |

| SEQ ID NO | | | | | | |
|---|---|---|---|---|---|---|
| SEQ_ID_NO_774 | KKWNPDVVF | NTWQHYGTPS | YWMQVLFRES | SGAIVHPTTI | 543 |
| SEQ_ID_NO_775 | QTWNPDAIVF | NSWQQYGTPS | YWMQTLFGES | SGAMFHPVTI | 544 |
| SEQ_ID_NO_776 | QTWNPDAIVF | NSWQQYGTPS | YWMQKFFNES | SGAMTHPLTI | 542 |
| SEQ_ID_NO_777 | RRWNPDAIVF | DSSQLYGTPS | YWQCLFNES | SGATLYNSTL | 548 |
| SEQ_ID_NO_778 | RRWNPDAIVF | DSSQLYGTPS | YWQCLFNES | SGATLYNSTL | 548 |
| SEQ_ID_NO_780 | RRWNLDAIVF | NSFQLYGTPS | YWQLFSES | SGATLLSTSL | 550 |
| SEQ_ID_NO_781 | RRWNPDAIVF | DSSQLYGTPS | YWQCLFNES | SGATIFNATL | 547 |
| SEQ_ID_NO_782 | RRWNPDAIVF | NSSHLYGTPS | YWQCFFNES | SGATIFNATL | 548 |
| SEQ_ID_NO_783 | KRWSPDAIVF | NSSMHYGTPS | YWLKFFNES | SGATLLDAKL | 540 |
| SEQ_ID_NO_785 | RRWNPDAIVF | TSSQMYGTPS | YWQRFAES | NGATLLSSSL | 546 |
| SEQ_ID_NO_786 | RRWNPDAIVF | NSSHLYGTPS | YWQHFFSNS | SGATLTSTL | 547 |
| SEQ_ID_NO_788 | RTWSPDAIVF | NSSFVYGTPS | YWMQHFFSNS | SGATLNSTL | 552 |
| SEQ_ID_NO_789 | | | | | 550 |

| SEQ ID | | | | | | | |
|---|---|---|---|---|---|---|---|
| SEQ_ID_NO_774 | VSPVKSQLFD | AG---- | AHMQV | TLAPHSFTSF | DLALAPSKL | 656 |
| SEQ_ID_NO_775 | VVPVKSQLSN | AA---- | EQMQV | TLAPHSFSSF | DLALAQSK- | 653 |
| SEQ_ID_NO_776 | VVPVTSQLHN | AA---- | EQMQV | TLAAHSFSSF | DLALAQSE- | 651 |
| SEQ_ID_NO_777 | VIPKRSLLES | AG---- | EEMEV | VISPRSFTSI | DLLMESSDVI | 662 |
| SEQ_ID_NO_778 | VIPKQSLLES | AG---- | EEMEV | VISPRSFTSI | DLLMESSDI- | 662 |
| SEQ_ID_NO_780 | VIPKQSLLES | VE---- | KDMNV | TVPPRSFTSF | DLLKQSSNEL | 663 |
| SEQ_ID_NO_781 | VIPKQSLLQN | ASI---- | EEMEV | VISPRSFTSI | DLLMESSDI- | 661 |
| SEQ_ID_NO_782 | VIPNRTLLEK | AGEDGE | EEMDV | AISPHSFTSI | DFLIESSF-- | 664 |
| SEQ_ID_NO_783 | VIPNLGLLEN | AG---- | EEMDV | GLSAHSFTSL | DLLVEPSH-L | 653 |
| SEQ_ID_NO_785 | VIPVKTQVEK | AD---- | KDMNI | TIAPYSLTSL | DLLTESNN-- | 657 |
| SEQ_ID_NO_786 | VVPHESLLE- | VSI---- | DNMDV | VLAPRSLNSI | DFLLRKS--- | 661 |
| SEQ_ID_NO_788 | VAPFRFELKD | AEI---- | EDMTM | VLPPHSFSSF | DLLKESAKL- | 662 |
| SEQ_ID_NO_789 | | VG---- | KDLDA | ELPAYSFTAF | DLLTDSSIS-L | 663 |

| SEQ ID | | | | |
|---|---|---|---|---|
| SEQ_ID_NO_774 | VTLAGRV-- | KYLISEL | N | 671 |
| SEQ_ID_NO_775 | -------- | LVAEM | | 658 |
| SEQ_ID_NO_776 | -------- | LVAEM | | 656 |
| SEQ_ID_NO_777 | RTTGAD- | SVSVSSI | | 675 |
| SEQ_ID_NO_778 | RTTGAD- | SVSVSSI | | 675 |
| SEQ_ID_NO_780 | KMAGSD- | SSTMSSI | | 676 |
| SEQ_ID_NO_781 | RTTGAD- | SVSVSSI | | 674 |
| SEQ_ID_NO_782 | RTTGAD- | SVSVSSI | | 677 |
| SEQ_ID_NO_783 | -TTGAD- | SSSLSSS | | 665 |
| SEQ_ID_NO_785 | RMPQTD- | SSARSSI | | 670 |
| SEQ_ID_NO_786 | NMVDTA-- | SVLKSSC | S | 674 |
| SEQ_ID_NO_788 | RMPISDSS | HQKTITV | | 678 |
| SEQ_ID_NO_789 | QTVETD- | AGYKSSI | | 676 |

| SEQ_ID_NO_416 | SVAVAYDPLD | PNGNITIKWD | IMSWTPDGYV | AVVTINNFQM | 56 |
| --- | --- | --- | --- | --- | --- |
| SEQ_ID_NO_418 | SVAVAYDPLD | PNGNITIKWD | LMSWTPDGYV | AVVTINNFQM | 56 |
| SEQ_ID_NO_419 | SVAVAYDPLD | PNGNITIKWD | IMSWTPDGYV | AVVTINNFQT | 58 |
| SEQ_ID_NO_420 | SVAVAYDPLD | PNGNITIKWD | VMSWTPDGYV | AMVTINNYQQ | 56 |
| SEQ_ID_NO_422 | SVAAAYDPLD | PNGNITIKWD | AMVAMNNYQQ | AMVAMNNYQQ | 57 |
| SEQ_ID_NO_423 | PHAAAYDPLD | PNGNVTIKWD | VMSWTPDGYV | ATVTMSNFQM | 75 |
| SEQ_ID_NO_424 | YCTSAYDPLD | PNGNVTIKWD | QSWTPDGYV | AVVAMNNFQM | 60 |
| SEQ_ID_NO_426 | SCAVAYDPLD | PTGNITIKWD | VMSWTPDGYV | AVVTMHNFQM | 54 |
| SEQ_ID_NO_427 | SHAIAYDPLD | PSGNITIKWD | VVSWTPDGYV | ALVTMNNFQM | 85 |
| SEQ_ID_NO_429 | FTATAYDPLD | PNGNITIKWD | LMSWTPDGYL | ATVTMNNFQM | 55 |
| SEQ_ID_NO_430 | LIVAAYDPLD | PTGNITIKWD | VISWTPDGYV | AVVTMNNFQI | 86 |
| SEQ_ID_NO_431 | SPTGAYDPLD | PNGNITIKWD | LMSWTADGYV | AVVTMYNFQQ | 74 |
| SEQ_ID_NO_433 | TSTEAYDALD | PTGNITIKWD | LVSWTADGYV | AVTMHNFQQ | 71 |
| SEQ_ID_NO_434 | SPAGAYDPLD | PNGNITIKWD | | | 80 |

| SEQ_ID_NO_416 | YRQIMAL | PGW | TVGWTVAKKE | VIWSMVGAQA | TEQGDCSRFK | 95 |
| --- | --- | --- | --- | --- | --- | --- |
| SEQ_ID_NO_418 | YRQIMAL | PGW | TVGWTVAKKE | VIWSMVGAQA | TEQGDCSRFK | 95 |
| SEQ_ID_NO_419 | YRQITAL | PGW | TVGWTVAKRE | VIWSMVGAQA | TEQGDCSRFK | 97 |
| SEQ_ID_NO_420 | YRQIMAL | PGW | TVGWTVAKRE | VIWSMVGAQA | TDQGDCSRFK | 95 |
| SEQ_ID_NO_422 | YRQIMAL | PGW | TLGWSWAKKE | VIWSIVGAQA | TEQGDCSKFK | 96 |
| SEQ_ID_NO_423 | YRHIIS | PGW | TLSWSVAKKE | VLWSMVGAQT | TEQGDCSKFK | 114 |
| SEQ_ID_NO_424 | YRHIPN | PGW | TLGWTVAKKE | VIWSMIGAQT | TEQGDCSKFK | 99 |
| SEQ_ID_NO_426 | YRHIMT | PGW | TLGWTVAKKE | VIWSMVGAQT | TEQGDCSKFK | 93 |
| SEQ_ID_NO_427 | YRHIQN | PGW | TLSWSVAKKE | VIWSMVGAQT | TEQGDCSKFK | 124 |
| SEQ_ID_NO_429 | FRHIMN | PGW | TLGWTVAKKE | VIWSMVGAQT | TEQGDCSKFK | 94 |
| SEQ_ID_NO_430 | YRHIQS | PGW | TLGWTVAKKE | VIWSMVGAQT | TEQGDCSKYK | 125 |
| SEQ_ID_NO_431 | YRHIQA | PGW | TLGWTVAKKE | VIWSMMGSQT | TEQGDCSKYK | 113 |
| SEQ_ID_NO_433 | YRHIPS | PPGW | TLGWNVAKKE | VIWAVVGQT | TEQGDCSKWK | 110 |
| SEQ_ID_NO_434 | | | | | | 120 |

Figure 7C

| SEQ_ID_NO | | | | | |
|---|---|---|---|---|---|
| SEQ_ID_NO_416 | GNIPHCCKRT | PAVVDLLPGV | PYNQQIANCC | RGGVISAYGQ | 135 |
| SEQ_ID_NO_418 | ANIPHCCKRT | PTVVDLLPGV | PYNQQIANCC | RGGVISAYGQ | 135 |
| SEQ_ID_NO_419 | ANLPHCCKRT | PAVVDLLPGV | PYNQQIANCC | RGGVSAYGQ | 137 |
| SEQ_ID_NO_420 | GGIPHCCKHT | PAVVDLLPGV | PYNQQIANCC | RGGVLPAYGQ | 135 |
| SEQ_ID_NO_422 | GNIPHCCKKT | PSVVDLLPGV | PYNQQIANCC | RGGVMAAWGQ | 136 |
| SEQ_ID_NO_423 | GNVPHCCKKT | PTLVDLLPGV | PYNQQFSNCC | KGGVAAWGQ | 154 |
| SEQ_ID_NO_424 | GNIPHCCKKT | PTVVDLLPGV | PYNQQFSNCC | KGGVAAWGQ | 139 |
| SEQ_ID_NO_426 | ANIPHCCEKT | PTVVDLLPGV | PYNQQIANCC | KAGVAAWGQ | 133 |
| SEQ_ID_NO_427 | GNVPHCCKKT | PTVVDLLPGV | PYNQQFSNCC | KGGVIGAWGQ | 164 |
| SEQ_ID_NO_429 | GNVPHCCKKT | PTVVDLLPGT | PYNQQIANCC | KGGVAAWGQ | 134 |
| SEQ_ID_NO_430 | GNIPHCCNKN | PTVVDLLPGV | PYNQQIANCC | KGGVIASWAQ | 165 |
| SEQ_ID_NO_431 | GNVPHCCKKD | PTVVDLLPGT | PYNQQIANCC | KGGVLNSWVQ | 153 |
| SEQ_ID_NO_433 | AGSPHCCKKD | PTVVDLLPGV | PYNQQFTNCC | KGGALASWAQ | 150 |
| SEQ_ID_NO_434 | | | | | 160 |

| SEQ_ID_NO | | | | | |
|---|---|---|---|---|---|
| SEQ_ID_NO_416 | DPGAAVAAFQ | VSVGQAGTTN | RTVKVPKNFT | LLGPGPGYTC | 175 |
| SEQ_ID_NO_418 | DPASAVAAFQ | VSVGQAGTTN | RTVKVPKNFT | LLGPGPGYTC | 175 |
| SEQ_ID_NO_419 | DPATAVAAFQ | VSVGQAGTTN | RTVKVPKNFT | LLGPGPGYTC | 177 |
| SEQ_ID_NO_420 | DPSAAAAAFQ | VSVGQAGTTN | RTVKVRLPKNFT | LLGPGPGYTC | 175 |
| SEQ_ID_NO_422 | APSAAAAAFQ | VSVGQAGTTN | RTVKLPKNFT | LMGPGPGYTC | 176 |
| SEQ_ID_NO_423 | DPAGALSAFQ | VSVGLAGTSN | KTVKLPKNFT | LLGPGPGYTC | 194 |
| SEQ_ID_NO_424 | DPTASVSAFQ | VSVGLAGTSN | KTVKLPKNFT | LLGPGPGYTC | 179 |
| SEQ_ID_NO_426 | DPSASVSAFQ | VSVGLAGTSN | KTVKLPKNFT | LLGPGPGYTC | 173 |
| SEQ_ID_NO_427 | DPSQAISSFQ | VSVGLAGTSN | KTVKLPRNFT | LLGPGPGYTC | 204 |
| SEQ_ID_NO_429 | DPAGSVSSFQ | VSVGQAGTTN | KTVKLPKNFT | LLGFAPGPGYTC | 174 |
| SEQ_ID_NO_430 | DPSAAVSAFQ | VSTGLAGTSN | KTVKLPKNFT | LLGPGPGYTC | 205 |
| SEQ_ID_NO_431 | DPSSAVSSFQ | VSVGNAGTTN | TTVRLPKNFT | LLGPGPGYTC | 193 |
| SEQ_ID_NO_433 | DPVNAVSAFQ | VSVGAAGTTN | KTVRVPRNFT | LKAPGPGYTC | 190 |
| SEQ_ID_NO_434 | DPPNSVASFQ | VSVGNSGTTN | KTVKLPKNFT | LKAPGPGYTC | 200 |

Figure 7D

| SEQ_ID_NO | Sequence | Pos | | Sequence | Pos |
|---|---|---|---|---|---|
| SEQ_ID_NO_416 | GPAKVVPSTV FLTPDRRRKT QALMTWNVTC TYSQYLASKY | 215 | | PSCCVSFSSF YNDTIVPCAK CACGCEHK- ---------- | 243 |
| SEQ_ID_NO_418 | GPGKIVPSTV FLTPDRRRKT QALMTWNVTC TYSQHLASKY | 215 | | PSCCVSFSSF YNDTIVPCAK CACGCEHK- ---------- | 243 |
| SEQ_ID_NO_419 | GPGKVVPSTV FLTPDRRRKT QALMTWNVTC TYSQHLASKY | 217 | | PSCCVSFSSF YNDTIVPCAK CACGCEHK- ---------- | 245 |
| SEQ_ID_NO_420 | GRARVVPSTV FLTPDRRRKT QALMTWNVTC TYSQHLASKY | 215 | | PSCCVSFSSF YNDTIVPCAK CACGCDAHK- ---------- | 244 |
| SEQ_ID_NO_422 | GPATVVPSTV FLTPDRRRKT QALMTWTVTC TYSQQLASRY | 216 | | PTCCVSFSSF YNSITVPCAR CACGCAHKS TGGRGGKSHS | 256 |
| SEQ_ID_NO_423 | GPAKVVPSTV FLTADHRRKT QAMMTWNVTC TYSQFLASKN | 234 | | PSCCVSFSSF YNETITPCPT CACGCQNKN- ---------- | 263 |
| SEQ_ID_NO_424 | GPAKIVPSTI FLTPDKRRKT QALMTWNVTC TYSQFLARKH | 219 | | PSCCVSFSSF YNDTITPCPS CACGCESKK- ---------- | 248 |
| SEQ_ID_NO_426 | GPAKIVPSTV FLTPDKRRKT QALMTWNVTC TYSQFLARKN | 213 | | PSCCVSFSSF YNDTITPCPS CACGCQNKK- ---------- | 242 |
| SEQ_ID_NO_427 | GPAKVVPSTV FLTADKRRKT QALMTWNVTC TYSQFLASKN | 244 | | SSCCVSFSSF YNETIMTPCPS CACGCRNKN- ---------- | 273 |
| SEQ_ID_NO_429 | GPAKTVKPTK YLTPDHRRKT QALMTWNVTC TYSQFLARKH | 214 | | PSCCVSLSSF YNETITPCPS CACGCENKK- ---------- | 243 |
| SEQ_ID_NO_430 | GPAKIVPSTV FLTPDKRRKT QALMTWNVTC TYSQFLARKN | 245 | | PSCCVSFSSF YNDTITPCPA CACGCQNKR- ----QL---- | 274 |
| SEQ_ID_NO_431 | GPAKIVPSTV FLTTDGRRVT QALMTWNITC TYSQFLAQKT | 233 | | PGCCVSLSSF YNDTIVPCPT CTCGCQNNT- ----QL-P-- | 265 |
| SEQ_ID_NO_433 | GRAVKPITK FITADKRKT QALMTWNITC TYSQFLAQKT | 230 | | PSCCVSFSSF YNNTINCPT CACGCQNST- ----EL-S-- | 262 |
| SEQ_ID_NO_434 | GPAKIVKSSL FSTDRRRIT QALMTWNVTC TYSQFLAQKS | 240 | | SITCCVSLSSF YNDTITPCPT CACACRNVT- ----QL--- | 271 |

Figure 7E

| SEQ_ID_NO | | | | | | | | | | 272 | 273 | 275 | 281 | 278 | 284 | 269 | 263 | 292 | 264 | 295 | 286 | 283 | 293 |
|---|---|---|---|---|---|---|---|---|---|---|---|---|---|---|---|---|---|---|---|---|---|---|---|
| SEQ_ID_NO_416 | - | - | T | C | V | Q | G | - | D | S | K | R | P | L | A | V | T | G | K | H | T | H | A | A | L | - | A | T | R | - | - | - | H | R | D | K |
| SEQ_ID_NO_418 | - | - | T | C | V | Q | G | - | D | S | K | R | L | L | A | V | T | G | K | H | E | H | A | H | A | - | A | A | R | - | G | - | H | R | D | K |
| SEQ_ID_NO_419 | - | - | T | C | V | Q | G | - | D | S | K | R | L | L | A | V | T | G | K | H | A | H | T | I | A | A | - | - | - | - | G | - | H | R | D | K |
| SEQ_ID_NO_420 | P | C | V | R | S | E | R | D | G | - | K | R | L | L | A | V | T | G | K | K | H | D | A | N | A | - | A | V | R | L | G | - | Q | H | R | D | K |
| SEQ_ID_NO_422 | D | G | C | I | - | A | G | - | D | S | K | R | - | A | L | T | P | G | V | N | - | - | - | N | A | H | G | R | G | N | G | V | A | A | A | M |
| SEQ_ID_NO_423 | S | C | V | K | S | - | - | - | N | S | K | E | - | S | H | K | K | G | I | N | - | - | - | - | T | - | - | - | - | - | - | - | P | K | K | D |
| SEQ_ID_NO_424 | G | C | V | K | S | - | - | - | D | S | K | I | - | L | S | V | K | G | I | N | - | - | - | - | T | - | - | - | - | - | - | - | P | R | K | D |
| SEQ_ID_NO_426 | H | C | V | K | G | - | - | - | D | S | K | L | - | L | S | M | V | G | V | H | - | - | - | - | T | - | - | - | - | - | - | - | P | K | K | D |
| SEQ_ID_NO_427 | M | C | I | S | S | - | - | - | D | S | K | K | - | L | K | F | - | A | L | H | - | - | - | - | N | - | - | - | - | - | - | - | P | K | R | S |
| SEQ_ID_NO_429 | S | C | V | K | A | - | - | - | D | S | K | R | - | L | T | K | K | G | L | N | - | - | - | - | - | - | - | - | - | - | - | - | P | K | K | D |
| SEQ_ID_NO_430 | N | C | I | K | S | - | - | - | D | S | P | V | I | N | M | V | G | I | H | - | - | - | - | - | T | - | - | - | - | - | - | - | P | K | K | D |
| SEQ_ID_NO_431 | G | T | C | V | E | S | - | - | R | S | S | H | - | L | P | S | L | L | N | - | - | - | - | - | - | - | - | - | - | - | - | - | S | P | K | N |
| SEQ_ID_NO_433 | G | S | C | V | S | E | - | - | R | S | P | V | - | L | A | S | A | V | P | - | - | - | - | - | G | - | - | - | - | - | - | - | K | S | T | N |
| SEQ_ID_NO_434 | P | S | C | V | H | S | - | - | D | S | P | V | - | L | K | L | P | G | P | T | - | - | - | - | N | - | - | - | - | - | - | - | P | I | T | N |

| SEQ_ID_NO | | | | | | | | | | 310 | 311 | 313 | 319 | 316 | 322 | 307 | 301 | 330 | 302 | 333 | 324 | 321 | 333 |
|---|---|---|---|---|---|---|---|---|---|---|---|---|---|---|---|---|---|---|---|---|---|---|---|
| SEQ_ID_NO_416 | - | - | E | A | P | L | L | Q | C | T | T | H | M | C | P | V | R | V | H | W | H | V | K | L | N | Y | K | E | Y | W | R | A | K | I | A | I | T | N | F | N |
| SEQ_ID_NO_418 | - | - | E | A | P | L | L | Q | C | T | T | H | M | C | P | V | R | V | H | W | H | V | K | L | N | Y | K | E | Y | W | R | A | K | I | A | I | T | N | F | N |
| SEQ_ID_NO_419 | - | - | E | A | P | L | L | Q | C | T | T | H | M | C | P | V | R | V | H | W | H | V | K | L | N | Y | K | E | Y | W | R | A | K | I | T | I | V | N | F | N |
| SEQ_ID_NO_420 | - | - | A | A | P | L | L | Q | C | T | T | H | M | C | P | V | R | V | H | W | H | V | K | L | N | Y | K | E | Y | W | R | A | K | I | A | V | T | N | F | N |
| SEQ_ID_NO_422 | - | - | G | A | Q | L | L | Q | C | T | N | H | M | C | P | I | R | V | H | W | H | V | K | V | N | Y | R | E | Y | W | R | A | K | V | A | V | T | N | F | N |
| SEQ_ID_NO_423 | - | - | N | T | P | L | L | Q | C | T | N | H | M | C | P | I | R | V | H | W | H | V | K | V | N | Y | R | D | Y | W | R | V | K | V | A | V | T | N | F | N |
| SEQ_ID_NO_424 | - | - | N | A | P | L | L | Q | C | T | H | H | M | C | P | I | R | V | H | W | H | V | K | T | N | Y | K | D | Y | W | R | V | K | I | A | I | T | N | F | N |
| SEQ_ID_NO_426 | - | - | N | E | P | L | L | Q | C | T | N | H | M | C | P | I | R | V | H | W | H | V | K | L | N | Y | K | D | Y | W | R | V | K | V | A | I | T | N | F | N |
| SEQ_ID_NO_427 | - | - | N | T | P | L | L | Q | C | T | N | H | M | C | P | I | R | V | H | W | H | V | K | L | N | Y | M | D | Y | W | R | V | K | I | T | I | T | N | F | N |
| SEQ_ID_NO_429 | - | - | N | E | P | L | L | Q | C | T | P | H | M | C | P | I | K | I | H | W | H | V | K | L | N | Y | K | E | Y | W | R | V | K | V | T | I | T | N | F | N |
| SEQ_ID_NO_430 | - | - | L | A | P | L | I | Q | C | T | S | H | M | C | P | V | R | I | H | W | H | V | K | L | N | Y | M | D | Y | W | R | V | K | V | A | V | T | N | F | N |
| SEQ_ID_NO_431 | - | - | A | P | P | L | L | Q | C | T | R | H | M | C | P | V | R | V | H | W | H | V | K | L | N | Y | K | E | Y | W | R | V | K | I | T | V | T | N | F | N |
| SEQ_ID_NO_433 | S | L | Q | P | P | L | L | Q | C | T | | | | | | | | | | | | | | | | | | | | | | | | | | | | | | | |

Figure 7F

| SEQ ID | | | | | | | | | |
|---|---|---|---|---|---|---|---|---|---|
| | 350 | 351 | 353 | 359 | 356 | 362 | 347 | 341 | 370 | 342 | 373 | 364 | 361 | 373 |

| SEQ ID NO | Col1 | Col2 | Col3 | Col4 |
|---|---|---|---|---|
| 416 | YRMNYTQWTL | VAQHPNLDNI | TEVFSFDYKP | VVAYGSI NDT |
| 418 | YHMNYTQWTL | VAQHPNLDNI | TEVFSFDYKP | VVAYGSI NDT |
| 419 | YHMNYTQWTL | VAQHPNLDNI | TEVFSFDYKP | VVSYGSI NDT |
| 420 | YRMNYT[G]WTL | VAQHPNLDNI | TEVFSF[G]YKP | VVSYGSI NDT |
| 422 | YRMNYTQWTL | VAQHPNLNNI | TEVFSF[Q]YKP | LLPYGSI NDT |
| 423 | YRMNYTEWTL | VVQHPNLNNV | TQVFSFDYKP | LVPYESI NDT |
| 424 | YRMNFSLWTL | AIQHPNLNNL | TQVFSFDYKP | LVPYESI NDT |
| 426 | YRMNHSLWGL | AVQHPNLNNV | TQLFSFDYKP | LVPYGSI NDT |
| 427 | YRMNYTQWTL | AIQHPNLNNV | TQLFSFNYKP | V[SP]YGSI NDT |
| 429 | YRMNHTLWTL | AVQHPNFDNL | TQVFSFNYKP | LPYESI NDT |
| 430 | YRMNYSLWTL | VVQHPNFDNV | TQLFSFNYKP | LTPYGK[I] NDT |
| 431 | Y[AL]NYSQWNL | VAQHPNLDNV | TQVFSFNYKP | LTPY[AG]L NDT |
| 433 | YRMNYTQWNI | VVQHPNFDNV | TQVFSFNYKP | LTPYGSI NDT |
| 434 | YRMN YT[DM]WTL | VAQHPNFDNV | TQVFSFNYKP | LTPYGSI NDT |

| | 390 | 391 | 393 | 399 | 396 | 402 | 387 | 381 | 410 | 382 | 413 | 404 | 401 | 413 |

| SEQ ID NO | Col1 | Col2 | Col3 | Col4 |
|---|---|---|---|---|
| 416 | AMFYGLKYFN | DHLMQAGPYG | NVQSEVLMRK | DASTFTFRQG |
| 418 | AMFYGLKYFN | DHLMQAGPYG | NVQSEVLMRK | DASTFTFRQG |
| 419 | AMFYGLKYFN | DHLMQAGPYG | NVQSEVLMRK | DASTFTFRQG |
| 420 | AMFYGLKYFN | D[QL]MEAGPHG | NVQSEVLMRK | DA[RT]TFTF[GQ]G |
| 422 | GMFYGLKYFN | DLLMEAGPFG | NVQSEVLMRK | D[AT]TFTFKQG |
| 423 | GMFYGLKFYN | DLLMEAGPFG | NVQSEVLLQK | DKNTFSLKQG |
| 424 | GMFYGMKFYN | DLLMEAGPTG | NVQSELLLQK | DRNTFTFKQG |
| 426 | GMFYGMKYYN | DLLVEAG[QH]G | NVQSEVLLQK | D[QK]DTFTFKQG |
| 427 | GMFY[GT]KFYN | DLLMEAGPTG | NVQSEI LLQK | NKDTFTFKQG |
| 429 | GMFYG[MK]FYN | DLLMEAG[PS]G | NVQSELLFQK | D[QKI]TFTFKQG |
| 430 | AMLWGVKYYN | DML MQAG[EM]G | NVQSELLFRK | DASTFTFEKG |
| 431 | AMLWGLKFYN | D[FL][NE]AG[PL]G | NVQSELLLRK | DKQTFTFKQG |
| 433 | AMFWG[QK]YYN | DLLMQAGPMG | SVQSELLLRK | DKQTFTFKQG |
| 434 | AMFWG[QK]YYN | DLLMQAGPMG | SVQSELLLRK | DKQTFTFKQG |

| | | | | | | |
|---|---|---|---|---|---|---|
| SEQ_ID_NO_2 | MRSP- | ---- | GLL- | ---- | LVAAA | -LAL- | 20 |
| SEQ_ID_NO_4 | MRSP- | ---- | ALL- | ---AAA | LVAAV | -AAG- | 22 |
| SEQ_ID_NO_6 | MGPP- | ---- | PTRWP | LAA- | LVAAA | -AG-G | 21 |
| SEQ_ID_NO_7 | MRRR | GAPSG | IGLW- | ---AAL | LVAAA | -AAG-G | 29 |
| SEQ_ID_NO_8 | MKSR- | ---- | LFN-- | EMFL | LI-LA | RSP-S | 22 |
| SEQ_ID_NO_10 | MKLP- | ---- | KLS-- | LFL | LL-L-Q | TKAAL-G- | 25 |
| SEQ_ID_NO_12 | MVRL- | ---- | KTS-- | LWL | LALV-SI | QLN---A- | 23 |
| SEQ_ID_NO_14 | MTRT- | ---- | VLQ-- | ANLT | QRYT-CL | AAS---- | 22 |
| SEQ_ID_NO_15 | MFRG- | ---- | RLV-- | LVLF | LVIFSNVF | -VSS-AGSSS | 28 |

| | | | | | | |
|---|---|---|---|---|---|---|
| SEQ_ID_NO_2 | ---- | G- | AGAA | TEEAYVTLLY | GDEFVLGVRV | 45 |
| SEQ_ID_NO_4 | ---- | V- | AAAA | TEEAYVTLLY | GDEFVLGVRV | 47 |
| SEQ_ID_NO_6 | ---- | G- | AAAA | TEEAYVTLLY | GDEFVLGVRV | 46 |
| SEQ_ID_NO_7 | ---- | AA | AAAA | KDEAYVTLLY | GDEFVLGVRV | 55 |
| SEQ_ID_NO_8 | ---- | P- | VRAS | GSEAYVTLLY | GDEFLLGVRV | 47 |
| SEQ_ID_NO_10 | ---- | K- | AQSS | SKEAYVTLLY | GDEFLLGVRV | 50 |
| SEQ_ID_NO_12 | ---- | F- | GSES | SKVAYVTLLY | GDEFLLGVRV | 48 |
| SEQ_ID_NO_14 | ---- | Q- | RSQR | TEEAYVTLLY | GDEFLLGVRV | 47 |
| SEQ_ID_NO_15 | RSFLTEGLNP | QAKI | A-GQSR | SEHAYATLLY | GDEFLLGVRV | 67 |

| | | | | | | |
|---|---|---|---|---|---|---|
| SEQ_ID_NO_2 | LGKSLRDTGT | RRDMVVLVSD | GVSEYSRKLL | QEDGW VNRI | 85 |
| SEQ_ID_NO_4 | LGKSLRDTGT | RRDMVVLVSD | GVSEYSRKLL | QADGW VNRI | 87 |
| SEQ_ID_NO_6 | LGKSIRDTGT | RRDMVVLVSD | GVSEYSRKLL | EADGW VKRI | 86 |
| SEQ_ID_NO_7 | LGKSIRDTDT | SRDLVVLVSD | GVSEYSRELL | EADGFI VKH L | 95 |
| SEQ_ID_NO_8 | LGKSIRDTGS | TKDMVVLVSD | GVSEYSRKLL | QADGW VELL | 87 |
| SEQ_ID_NO_10 | LGKSIRDTGS | TRDMVVLVSD | GVSDYAKKLL | KADGWMVEM | 90 |
| SEQ_ID_NO_12 | LGKSIRDTGS | TKDMVALVSD | GVSDYAKKLL | KADGVKVEKI | 88 |
| SEQ_ID_NO_14 | LGKSIRDTGS | TKDIVVLVSD | GVSDYAKLL | LADGW VEKI | 87 |
| SEQ_ID_NO_15 | LGKSIRDTGV | TKDMVALVSD | GVSDAGIRLL | EADGM VQRI | 107 |

Figure 8B

| SEQ_ID_NO | Block 1 | | Block 2 | | Pos |
|---|---|---|---|---|---|
| SEQ_ID_NO_2 | TLLANPNQVR | PKRFWGVYTK | LKIFNMTSYK | KVVYYLDADTI | 125 |
| SEQ_ID_NO_4 | TLLANPNQVR | PKRFWGVYTK | LKIFNMTNYK | KVVYYLDADTI | 127 |
| SEQ_ID_NO_6 | TLLANPNQVR | PTRFWGVYTK | LKIFNMTSYK | KVVYYLDADTV | 126 |
| SEQ_ID_NO_7 | TLLANPNQVR | PTRFWGVYTK | LKIFNMTSYK | KVAYLDADTI | 135 |
| SEQ_ID_NO_8 | SLLANPNQVR | PKRFWGVYTK | LKIFNMTNYK | KVVYYLDADTI | 127 |
| SEQ_ID_NO_10 | SLLANPNQVR | PTRFWGVYTK | LKIFNMTDYK | KVVYYLDADTI | 130 |
| SEQ_ID_NO_12 | SLLANPNQVH | PKRFWGVYTK | LKIFNMTNYK | KVVYYLDADTI | 128 |
| SEQ_ID_NO_14 | SLLANPNQVR | PTRFWGVYTK | LKIFNMTDYR | KVVYYLDADTI | 127 |
| SEQ_ID_NO_15 | ELLANPNSKR | PTRFWGVYTK | LKIFNMTDYR | KVVYYLDADTI | 147 |

| SEQ_ID_NO | Block 1 | | Block 2 | | Pos |
|---|---|---|---|---|---|
| SEQ_ID_NO_2 | VVKSIEDLFK | CGKFCGNLKH | SERMNSGVMV | VEPSETLFND | 165 |
| SEQ_ID_NO_4 | VVKSIEDLFK | CGKFCGNLKH | SERMNSGVMV | VEPSETLFND | 167 |
| SEQ_ID_NO_6 | VVKSIEDVFK | CRKFCGNLKH | SERMNSGVMV | VEPSETVFKD | 166 |
| SEQ_ID_NO_7 | VVKSIEDIFN | CGKFCGNLKH | SERMNSGVMV | VEPSETVFND | 175 |
| SEQ_ID_NO_8 | VVKSIEDLFK | CGKFCANLKH | SERLNSGVMV | VEPSETVFND | 167 |
| SEQ_ID_NO_10 | VVKSIEDLFK | CQKFCANLKH | SERLNSGVMV | VEPSEAVFND | 170 |
| SEQ_ID_NO_12 | VVKNIEDLFK | CSKFCANLKH | SERLNSGVMV | VEPSEALFND | 168 |
| SEQ_ID_NO_14 | VVKSIEDLFK | CAKFCANLKH | SERLNSGVMV | VEPSETVFNN | 167 |
| SEQ_ID_NO_15 | VTRSIEDLFE | CQSFCANLKH | SERLNSGVMV | VEPSRDLFED | 187 |

| SEQ_ID_NO | Block 1 | | Block 2 | | Pos |
|---|---|---|---|---|---|
| SEQ_ID_NO_2 | MIDKVGRLPS | YTGGDQGFLN | SYYPDFPNSR | VYEPDSPL--- | 202 |
| SEQ_ID_NO_4 | MINKVGQLPS | YTGGDQGFLN | SYYSDFANSR | VYEPDSPL--- | 204 |
| SEQ_ID_NO_6 | MISQVDRLPS | YTGGDQGFLN | SYYADFANSR | VYEPDSPL--- | 203 |
| SEQ_ID_NO_7 | MMDKVNSLPS | YTGGDQGFLN | SYYADFANSR | VYEPNKPLSPEE | 212 |
| SEQ_ID_NO_8 | MMSKVNTLPS | YTGGDQGFLN | SYYTGFASAH | VFDPDLSPEEV | 207 |
| SEQ_ID_NO_10 | MMRKVKTLPS | YTGGDQGFLN | SYYSDFSNAH | VFDPNIPEEV | 210 |
| SEQ_ID_NO_12 | MMSKVKTLSS | YTGGDQGFLN | SYYPDFPNAR | VFDPSVTPEV | 208 |
| SEQ_ID_NO_14 | MMSKVTTLPS | YTGGDQGFLN | SYYEEFPNAH | VFQPGLPEEV | 207 |
| SEQ_ID_NO_15 | MMSKVGNTYS | YTGGDQGFLN | SYYVGFADAE | LFNPELSPEI | 227 |

Figure 8C

| | | | | | |
|---|---|---|---|---|---|
| SEQ_ID_NO_2 | - - - - - LTPEPETQ | RLSTLYNADV | GLYMLANKVM | VDEKELRVIH | 240 |
| SEQ_ID_NO_4 | - - - - - LTPEPETQ | RLSTLYNADV | GLYMLANKVM | VDEKELRIIH | 242 |
| SEQ_ID_NO_6 | - - - - - LTPEPETQ | RLSTLYNADV | GLYMLANKVM | VDEKELRVIH | 241 |
| SEQ_ID_NO_7 | - - - - - TTPEPETQ | RLSTLYNADV | GLYMLANKVM | VDEKELRVIH | 250 |
| SEQ_ID_NO_8 | RNARPVPKME | RLSTLYNADV | GLYMLANKVM | VDEKELRVIH | 247 |
| SEQ_ID_NO_10 | LKSRPAPEME | RLSTLYNADV | GLYMLANKVM | VDESELRVIH | 250 |
| SEQ_ID_NO_12 | LKTRPVPAME | RLSTLYNADV | GLYMLANKVM | VDDSKLHVIH | 248 |
| SEQ_ID_NO_14 | RKSRPVPDME | RLSTLYNADV | GLYMLANKVM | VDENELRVIH | 247 |
| SEQ_ID_NO_15 | RKARPFKKME | RLTTLYNADV | GLFALANKVM | VDASELRVIH | 266 |

| | | | | | |
|---|---|---|---|---|---|
| SEQ_ID_NO_2 | YTLGPLKPWD | WFTAWLVKPV | GTWQDIRQKL | EESLPGTGGG | 280 |
| SEQ_ID_NO_4 | YTLGPLKPWD | WFTAWLVKPV | ETWQDIRQKL | EESLPGTGGG | 282 |
| SEQ_ID_NO_6 | YTLGPLKPWD | WWTAWLVKPV | EIWQDVRQKL | EESLPGTGGG | 281 |
| SEQ_ID_NO_7 | YTLGPLKPWD | WWTSWLLKPV | AVWQDIRKNL | EESLPGTGGG | 290 |
| SEQ_ID_NO_8 | YTLGPLKPWD | WWTSWLLKPV | DVWQNVREQL | EGSLPGTEGG | 287 |
| SEQ_ID_NO_10 | YTLGPLKPWD | WWTAWLVKPV | DVWQNVREQL | KESLPGTGGG | 290 |
| SEQ_ID_NO_12 | YTLGPLKPWD | WWTSWLLKPV | DAMHSIRVKL | EETLPGTGGG | 288 |
| SEQ_ID_NO_14 | YTLGPLKPWD | WWTAWLVKPV | DVWQRVREQL | DESLPGTGGG | 287 |
| SEQ_ID_NO_15 | YTLGPLKPWD | WYAEMLLEPV | KMMQDIRVTL | EETLPGTQQG | 306 |

| | | | | | |
|---|---|---|---|---|---|
| SEQ_ID_NO_2 | RNPHDQLVVK | LFLFPFCLL | LFGYYQSCFQ | TNKEL - - SI | 318 |
| SEQ_ID_NO_4 | RNPHDQLVVK | LILFPFCLL | LFGYYQSCFQ | TNKEL - - SI | 320 |
| SEQ_ID_NO_6 | RNPHDQLVVK | FLLPFCLL | LFGYYQSCFQ | NYKDF - - PSV | 319 |
| SEQ_ID_NO_7 | RNPHDQSVVK | LLFSLPEML | LCGYYGSCFQ | TNKEL - - LCI | 328 |
| SEQ_ID_NO_8 | RNPNDTLVK | FLFLLPLLAL | FCYYRSFLQ | TREFFGSFCR | 327 |
| SEQ_ID_NO_10 | KNPNDELLIK | FLFLLPLCAL | LFCFYRSFLQ | TGGS - - - VCR | 327 |
| SEQ_ID_NO_12 | SNQHDELVVK | FLFLLPLCAL | LFCTYRSFVQ | REGS - - - LCW | 325 |
| SEQ_ID_NO_14 | KNPKDELLVK | VLFLLPLCLV | LLCYYRSFLQ | QG | 317 |
| SEQ_ID_NO_15 | RDPRTSLITW | TLFLIPLLAL | SYMKRALLLQ | IQKDL - - EGL | 344 |

| | | | | | |
|---|---|---|---|---|---|
| SEQ_ID_NO_2 | HVGFN- | NSD | SSENHL GSG- | HQRNMSDCDM | DATFYW GMA | 470 |
| SEQ_ID_NO_4 | HVGFS- | NSD | ASENHMGPG- | HQRNMSDCDM | DATFYW GMA | 471 |
| SEQ_ID_NO_6 | HVGYS- | NSD | SSENHMATGH | HQRNI SDFDM | EATFYW TGMA | 473 |
| SEQ_ID_NO_7 | HVGHN- | NLD | SSENHAGAG- | LQRNTSDCDT | DAAFYVS GMA | 481 |
| SEQ_ID_NO_8 | QAGSFAS | RPV | SADYDSGKG- | HQRQVSSCDA | ATWYYGL GMA | 479 |
| SEQ_ID_NO_10 | PVS-SF- | RMD | PIDSDSRKG- | -YRQASSCDV | VTWYYGL GMA | 475 |
| SEQ_ID_NO_12 | QSE--- | -SS | SLF-DDSAKV- | HQRAGGSCDV | TITLYYGL GMA | 469 |
| SEQ_ID_NO_14 | QAASLSPHSE | AEE | SLAYDSRKG- | HFRQGSTCDV | AAWYYGL GMA | 432 |
| SEQ_ID_NO_15 | KSLSV-- | | ISLYSTDKL- | HSKNSVSMDT | ETSTYGI VTIA | 500 |

| | | | | | |
|---|---|---|---|---|---|
| SEQ_ID_NO_2 | VI ATVAVLLP | | TI LGI TALFT | KLGL MVAGGV | VLASF MTYAA | 510 |
| SEQ_ID_NO_4 | TI ATI TVLLP | | TI LGI TALFT | KLGL MVAGGI | VLASF MTYAA | 511 |
| SEQ_ID_NO_6 | VI ALI TVFSP | | TI LGI TALFA | KLGL MVAGGV | VLASF MTYAS | 513 |
| SEQ_ID_NO_7 | ILS ALLSP | | TVLGI TALFL | KLGL MVAGAL | LLASF MTYAS | 521 |
| SEQ_ID_NO_8 | FLA VAAPSLP | | CVFGVTALFL | RLGLI AVGAL | LLAAF MTYAA | 519 |
| SEQ_ID_NO_10 | FLA AAPSLP | | CI FGI TALFM | RLGL MVGGL | ILAAF MTYAS | 515 |
| SEQ_ID_NO_12 | FLA AAVSLP | | YI LGI TALFL | RLGL MV GLAI | ILAAF MTYAS | 509 |
| SEQ_ID_NO_14 | LLA VGAPSLP | | CI FGVTALFL | RLGL MV AGGL | VLASF MTYAS | 472 |
| SEQ_ID_NO_15 | LVALLT PALP | | RL FGITI IFA | RIAGL MVSGVF | LLA VVATYSA | 540 |

| | | | | |
|---|---|---|---|---|
| SEQ_ID_NO_2 | EHLAI SAFNK | GQKDRL NALR | TRSFCF--- | 534 |
| SEQ_ID_NO_4 | EHLAI SAFNK | GQKDRL NASR | TRSFCF--- | 536 |
| SEQ_ID_NO_6 | VHLAI SAFHK | GQKDRL NGSR | TRRI CF WCL | 541 |
| SEQ_ID_NO_7 | EHLAI SAFVK | GQRDRL NASR | -GSI CFM C | 547 |
| SEQ_ID_NO_8 | EHLAI RSFVK | GLEDRL DTPR | SRSVCFLI C | 546 |
| SEQ_ID_NO_10 | EHLAI RSFLK | GLEDRL NTTR | SRSACFLI C | 542 |
| SEQ_ID_NO_12 | EHLAI RSFLK | GLEDRRDTTR | SNSLCFLI C | 537 |
| SEQ_ID_NO_14 | EHLAV RWFLK | GFEDRL DTAR | ARNECFL F | 499 |
| SEQ_ID_NO_15 | EKLAV HMFLK | GQNDC- SYLE | ----R | 560 |

Figure 9A

| | | | | | | |
|---|---|---|---|---|---|---|
| SEQ_ID_NO_157 | M- | KSGER- | P- | -KLVR- | -G- | LRQESRRFRL | LVIVVGFFLV | 32 |
| SEQ_ID_NO_158 | M- | KSGER- | P- | -KLVR- | -G- | LRQESRRFRL | LVIVVGFFLV | 32 |
| SEQ_ID_NO_160 | M- | KSGER- | P- | -KLVR- | -G- | LRQESRRFRL | LVIVVGFFLV | 32 |
| SEQ_ID_NO_161 | M- | KSGER- | P- | -KQMR- | -G- | LRQESRRFRL | LVIVAGFFLV | 32 |
| SEQ_ID_NO_162 | M- | KSGER- | P- | -KLVR- | -G- | LRQESRRFRL | LVIVVGFFLV | 32 |
| SEQ_ID_NO_163 | M- | KAGER- | P- | -KLVR- | -G- | VRQESRRFRL | LAIVVGFFLV | 36 |
| SEQ_ID_NO_164 | M- | KAGER- | P- | -KLVR- | -G- | GRQESRRFRM | LSIVVGCFLI | 28 |
| SEQ_ID_NO_165 | M- | KQQ--- | PNSKLLRGG | -GYG- | -G- | VRFESQRFRL | YGAFIASLLF | 35 |
| SEQ_ID_NO_167 | M- | TEKDLLFD | T-- | -ILAR- | -SF | RNEPKRLFG | VGEFLGFFLV | 3 |
| SEQ_ID_NO_168 | M- | STL---- | --- | ------ | --- | --------- | HGVIVGCLLA | 32 |
| SEQ_ID_NO_170 | M- | GDDHG-- | A-- | -KLVK- | -S- | -SFEKERLT | ---------- | 27 |
| | M- | HKC---- | --- | -TLFC- | -S- | LRGAAQKYVG | ---------- | |

| | | | | | | |
|---|---|---|---|---|---|---|
| SEQ_ID_NO_157 | SLTFVVISKP | DAI | -L- | -FS | LNGKLPVEQA | PTSILIKQKV | 68 |
| SEQ_ID_NO_158 | SLTFVVISKP | DAI | -L- | -FS | LNGKLPVDQA | PTSILIQQKV | 68 |
| SEQ_ID_NO_160 | SLTFVVISKP | DAI | -L- | -FS | LNGKLPVDQA | PTSILIQQKV | 68 |
| SEQ_ID_NO_161 | SLTFVVISKP | DSI | -L- | -SS | LNGKLPVDQA | PTSILIQQKV | 68 |
| SEQ_ID_NO_162 | SLTFVVISKP | DAI | -L- | -FS | LNGKLPVEQA | PTSILIQQKV | 68 |
| SEQ_ID_NO_163 | SLTFVLVSKP | DSI | -L- | -FS | LNGKLPADQA | PASILIQQKV | 72 |
| SEQ_ID_NO_164 | SVTFLLSTRP | YLS- | -V- | -FG | T---PPARTA | IKTVKPSSSF | 61 |
| SEQ_ID_NO_165 | VETLCTVFKP | DSI- | -PL- | -FD | VEMQLSVDAG | LRML------ | 66 |
| SEQ_ID_NO_167 | LI-VNDT-- | FAI | -A- | -PI | ---------- | ---------- | 11 |
| SEQ_ID_NO_168 | LLTYFTVSEQ | --- | -A- | --- | ---------- | ---------- | 47 |
| SEQ_ID_NO_170 | AFTISIVFKS | YFCTQ | LSVLH | | LQSQSSMDAA | ENQFMMF--- | 64 |

Figure 9B

| SEQ_ID_NO | | | | | | |
|---|---|---|---|---|---|---|
| SEQ_ID_NO_157 | DSPPATSR- | ---- | ---- | ---- | KTATDALP | 84 |
| SEQ_ID_NO_158 | NSPPATTL- | ---- | ---- | ---- | RTSTDALR | 84 |
| SEQ_ID_NO_160 | NSPPATTV- | ---- | ---- | ---- | KTSTDALR | 84 |
| SEQ_ID_NO_161 | NSPPATAL- | ---- | ---- | ---- | ETSTDALR | 84 |
| SEQ_ID_NO_162 | NEPSGESR- | ---- | ---- | ---- | KTSTDALR | 84 |
| SEQ_ID_NO_163 | NTPA-Q--- | ---- | ---- | ---- | KTSTDAL- | 85 |
| SEQ_ID_NO_164 | SSPRGLGRDF | LVDIAPKQGD | ---- | ---- | GEKTETEWL | 100 |
| SEQ_ID_NO_165 | ----R----- | ---- | AHGRQPQLSA | ---- | TTEPQALR | 75 |
| SEQ_ID_NO_167 | ---------- | ---- | ---- | ---- | --SH---- | 13 |
| SEQ_ID_NO_168 | ---------- | ---- | ---- | ---- | ---- | 49 |
| SEQ_ID_NO_170 | ---------- | ---- | ---- | ---- | --PN---- | 64 |

| SEQ_ID_NO | | | | | | |
|---|---|---|---|---|---|---|
| SEQ_ID_NO_157 | G- | EADVRPKGTK | R--- | EEEESRV | LSEP-DPT- | 118 |
| SEQ_ID_NO_158 | G- | EADPRPQGFK | G--- | EEEESRV | LSEP-DPT- | 118 |
| SEQ_ID_NO_160 | ---- | EADPRPQGFK | G--- | EEEESRV | LSEP-DPT- | 117 |
| SEQ_ID_NO_161 | ---- | EADPRPQGFK | GL-- | EEEEGRV | LSEP-DAT- | 117 |
| SEQ_ID_NO_162 | ---- | EADAKPKGTG | GGS | EEEDHRV | LSEP-DPT- | 119 |
| SEQ_ID_NO_163 | G- | ETYVKPKEIR | GG- | EQEEADK | DPA-DPA- | 120 |
| SEQ_ID_NO_164 | ---- | SSAVA--AER | A--- | -ET | ATAP-TPAR | 132 |
| SEQ_ID_NO_165 | SSNDETSADS | DKLIPTNQD | NV- | TSS-- | TQSLTSSE- | 111 |
| SEQ_ID_NO_167 | GESE-RDA | EIMNSTSD | NA- | TSRSQEV | FKES-HTQ- | 47 |
| SEQ_ID_NO_168 | GT-RRTSPG | HLTLTSPAVA | EK- | TVQQQL | PVKR-EEA- | 83 |
| SEQ_ID_NO_170 | | | | | | 64 |

Figure 9C

| SEQ_ID_NO | | | | | | |
|---|---|---|---|---|---|---|
| SEQ_ID_NO_157 | ---------- | ---------- | SGMT | ELTANKDGGG | RKSDEETLGG | 142 |
| SEQ_ID_NO_158 | ---------- | ---------- | SGMT | ELTPNKDGSG | RKSDGEKLGG | 142 |
| SEQ_ID_NO_160 | ---------- | ---------- | SGMT | ELTPNKDGSG | RKSDEDKLGG | 141 |
| SEQ_ID_NO_161 | ---------- | ---------- | SGMT | ELTPDKDGSG | RKSNEEVLGG | 141 |
| SEQ_ID_NO_162 | ---------- | ---------- | SGMM- | EPTHNKDGNG | HKSHQETLGG | 143 |
| SEQ_ID_NO_163 | ---------- | ---------- | SGMA | EPAANKDGDA | RKSSDETLGG | 144 |
| SEQ_ID_NO_164 | ---------- | RGRYPRYYVH | SCAGRTGNV- | PHDANKSWGA | RDVDVLIELA | 171 |
| SEQ_ID_NO_165 | ---------- | ---------- | DHKL | NDTSMP---- | ---------- | 121 |
| SEQ_ID_NO_167 | ---------- | ---------- | NMKT | NDTSNS---- | ---------- | 57 |
| SEQ_ID_NO_168 | ---------- | ---------- | PLPEH | EQVHEK---- | ---------- | 94 |
| SEQ_ID_NO_170 | ---------- | ---------- | ---- | ----KDAG- | ---------- | 68 |

| SEQ_ID_NO | | | | | | |
|---|---|---|---|---|---|---|
| SEQ_ID_NO_157 | EGKGKQ-DGE | ERG- | HAAEKH | KVTLPTVS- | ---N-YTIH- | 173 |
| SEQ_ID_NO_158 | GGDGE-GKRNE | EPG- | HAADKH | KVTLPTVS- | ---N-YTIH- | 174 |
| SEQ_ID_NO_160 | GGDGE-GKRRE | ERG- | HEADKH | KVTLPTVS- | ---N-YTIH- | 173 |
| SEQ_ID_NO_161 | GGDGE-GKSKE | DRG- | HGPEKH | KVTLPTVS- | ---N-YTIH- | 173 |
| SEQ_ID_NO_162 | GGDGESKGND- | EEGE | HAEQKH | KVTLPTVS- | ---N-YTIH- | 176 |
| SEQ_ID_NO_163 | ERKDEAE-E-- | ERF- | DEEKHA | KVTLPTVS- | ---T-YTIH- | 173 |
| SEQ_ID_NO_164 | GATEEVRDH- | AAA- | ITARPA | VDTTPTPA- | ---N-TTRH- | 203 |
| SEQ_ID_NO_165 | ---------- | ---- | ------ | KNYL-DSF- | -----YTIN- | 133 |
| SEQ_ID_NO_167 | ---------- | ---- | ------ | PPLVKEN-- | -----YMVN- | 70 |
| SEQ_ID_NO_168 | ---------- | ---- | ------ | PPPVDDD-- | ---DT----- | 111 |
| SEQ_ID_NO_170 | ---------- | ---- | ------ | ---------- | EEPHREIEEP | 68 |

Figure 9D

| | | | | | | | |
|---|---|---|---|---|---|---|---|
| SEQ_ID_NO_157 | DS | ED | — | — | — | — | — | 177 |
| SEQ_ID_NO_158 | DT | ED | — | — | — | — | — | 178 |
| SEQ_ID_NO_160 | DT | ED | — | — | — | — | — | 177 |
| SEQ_ID_NO_161 | DT | ED | — | — | — | — | — | 177 |
| SEQ_ID_NO_162 | DA | AED | — | — | — | — | — | 181 |
| SEQ_ID_NO_163 | DA | ED | — | — | — | — | — | 177 |
| SEQ_ID_NO_164 | DQ- | DQ | PLPVE | EETRKAGGGK | IKLQAEPAAT | EPQQLPTPGR | 242 |
| SEQ_ID_NO_165 | TI | IS | — | — | — | — | — | 137 |
| SEQ_ID_NO_167 | NT | NS | — | — | — | — | — | 74 |
| SEQ_ID_NO_168 | NS | QT | — | — | — | — | — | 115 |
| SEQ_ID_NO_170 | — | L | — | — | — | — | — | 69 |

| | | | | | | |
|---|---|---|---|---|---|---|
| SEQ_ID_NO_157 | TE | NGKQ | DDGT | GSDLQGSK | PLCDFSN | FR | 204 |
| SEQ_ID_NO_158 | TE | NAKR | DDIT | SYDQGSK | PLCDFSN | FR | 204 |
| SEQ_ID_NO_160 | TE | TAKK | DDIT | SYDQGSK | PLCDFSN | FR | 203 |
| SEQ_ID_NO_161 | TQ | NAKQ | DDIT | SNDQGSK | PLCDFSN | FR | 203 |
| SEQ_ID_NO_162 | TE | NAKQ | EGIM | NNVQQGSK | PLCDFSN | FR | 207 |
| SEQ_ID_NO_163 | AE | NAKQ | EGIL | QQQQGSK | PLCDFSN | FR | 211 |
| SEQ_ID_NO_164 | LETSE | PERR | AS-R- | HEQQQQQQLSLSNVQ | DQPPQLLP | RR | 271 |
| SEQ_ID_NO_165 | KE | EVIS | DEI | NKLEKTMK | PICTKLA- | R | 161 |
| SEQ_ID_NO_167 | SLPKATD | ADIV- | VTKNNTIE | PLCTLMG | R | 100 |
| SEQ_ID_NO_168 | EHPIGEA | SK-I | TAEESAPAKK | PACDIQGP | WA | 147 |
| SEQ_ID_NO_170 | LQ | ELVE | EI | SITSAKSIF | NACDCEP- | I | 92 |

Figure 9 E

| SEQ_ID_NO | | | | | | | |
|---|---|---|---|---|---|---|---|
| SEQ_ID_NO_157 | ANVCEMR- | GDVRVHPNAT | SI MF ME- | - - - | PAGSQ | RDEL | 236 |
| SEQ_ID_NO_158 | ANVCEMR- | GDVRVHPNAT | SI MF ME- | - - - | PGHSQ | RDEL | 236 |
| SEQ_ID_NO_160 | ANVCEMR- | GDVRVHPNAT | EI MF ME- | - - - | PGHSQ | RDEL | 235 |
| SEQ_ID_NO_161 | ANVCEMR- | GDVRVHPNAA | SI MF ME- | - - - | PGHSQ | RDEL | 235 |
| SEQ_ID_NO_162 | ANVCEMR- | GDVRI HPTAT | SVLF ME- | - - - | PEGSQ | RDEV | 239 |
| SEQ_ID_NO_163 | ANVCEMR- | GDVRVHPKAT | SVLF ME- | - - - | PEGSQ | RDEV | 243 |
| SEQ_ID_NO_164 | SDVCDFT- | GDI RMDANAS | TEFLMV- | - - - | DAAT- | -AAS | 301 |
| SEQ_ID_NO_165 | TEFCELN- | GDVRVHGKSA | TVSAAI- | - - - | TFAFS- | GNST | 193 |
| SEQ_ID_NO_167 | SDFCEI KL | GDI RI DGKSY | TVFI VSI- | - - - | DI LITA | ENTS | 135 |
| SEQ_ID_NO_168 | SDVCDLAGGS | GGVRI HGSAH | TVLVPPT | SET | SGGSNP | NPQE | 186 |
| SEQ_ID_NO_170 | SNYCEI N- | GDVAMQGNSS | TI SMVSI- | EI LR- | TDI PA | GEI S | 126 |

| SEQ_ID_NO | | | | | | | |
|---|---|---|---|---|---|---|---|
| SEQ_ID_NO_157 | MKI KPYPRKG | DEFCLSHI TE | LTVKS- | SKV | - - - | AP | 266 |
| SEQ_ID_NO_158 | MKI KPYPRKG | DEFCLSHI TE | LTVKS- | SKV | - - - | AP | 266 |
| SEQ_ID_NO_160 | MKI KPYPRKG | DEFCLSHI TE | LTVKS- | SKV | - - - | AP | 265 |
| SEQ_ID_NO_161 | MKI KPYPRKG | DEFCLSHI TE | LTVKS- | SKV | - - - | AP | 265 |
| SEQ_ID_NO_162 | MKI KPYPRKG | DEFCLSHI TE | LTVKS- | SKV | - - - | AP | 269 |
| SEQ_ID_NO_163 | MKI KPYPRKG | DEFCLSHI TE | VTVKS- | SKV | - - - | AI A | 273 |
| SEQ_ID_NO_164 | HKVRPYARKG | DPTCMGRVPE | I TMRTT | SSIS | - - - | PP | 333 |
| SEQ_ID_NO_165 | MHI RPYARKG | DTVAMKRVRE | WTVKL- | EQN | ADQLEN | ANFS | 231 |
| SEQ_ID_NO_167 | WSI RPYARKG | DQAAMGAVRE | WTVKL- | VTV | A- - - | SDI P | 168 |
| SEQ_ID_NO_168 | WRVLPYSRKH | - - - - - - - - - - | I TVRE- | LAT | P- - - | ADAP | 215 |
| SEQ_ID_NO_170 | MTVKPYVRKE | NAAAMDLVKS | WAVTS- | ME- | - - - | EL | 155 |

| SEQ_ID | | | | | | | |
|---|---|---|---|---|---|---|---|
| SEQ_ID_NO_157 | EQVHCFKHVI | VGLH--AYM- | ------- | EFTI | DSS | KAPHNYSMVD | 377 |
| SEQ_ID_NO_158 | DQVHCFKHVI | VGLH--AYM- | ------- | EFTI | DSS | KAPHNYSMVD | 377 |
| SEQ_ID_NO_160 | DQVHCFKHVI | VGLH--AYM- | ------- | EFTI | DSS | KAPHNYSMVD | 376 |
| SEQ_ID_NO_161 | GEVHCFKHVI | VGLH--AYM- | ------- | EFTI | DSS | KAPHNYSMVD | 376 |
| SEQ_ID_NO_162 | DQVHCFKHAI | VGLH--AYM- | ------- | EFTI | DST | KAPHNYSMVD | 380 |
| SEQ_ID_NO_163 | DQVRCFKHAI | VGLH--AYM- | ------- | EFTI | DAA | KSPNGVTMAD | 384 |
| SEQ_ID_NO_164 | GETHCFRHAV | VGTH--AHR- | ------- | EL-- | ERD | RSPDGLATPD | 447 |
| SEQ_ID_NO_165 | DETHCFSSVT | VSLR--RHRE | YFKEL-TI | DPS | NSF- | -EYSMSD   | 344 |
| SEQ_ID_NO_167 | QDI-HCYDSMT | VGLT--KRRTNK | ------- | ELSI | DPD | PSSSPPYSMKD | 281 |
| SEQ_ID_NO_168 | DQVRCFPSAV | VGIRF-MPK- | ------- | EFSI | DPA | KEPTGHSMPE | 326 |
| SEQ_ID_NO_170 | RKTHCYPSMI | VGLK--YHH- | ------- | ELGI | DQS | QLSMKD    | 264 |

| SEQ_ID | | | | | |
|---|---|---|---|---|---|
| SEQ_ID_NO_157 | FNRFMRGAYS | LPRDTVT--- | VLGEYPKVKP | RLLI KRHRT | 414 |
| SEQ_ID_NO_158 | FNRFMRGAYS | LGRDTVT--- | VLGEYPKVKP | RLLI KRHRT | 414 |
| SEQ_ID_NO_160 | FNRFMRGAYS | LGRDTVT--- | VLGEYPKVKP | RLLI KRHRT | 413 |
| SEQ_ID_NO_161 | FNRFMRGAYS | LGRDSVT--- | LLGEYPKVKP | RLLI KRHRT | 413 |
| SEQ_ID_NO_162 | FNRFMRGAYS | LGRDSVT--- | VLGEYPKIKP | RLLI KRHRT | 417 |
| SEQ_ID_NO_163 | FNRFMRAAYS | LPKAAAA--- | ALGESPRVKP | RLLI KRHRT | 421 |
| SEQ_ID_NO_164 | FTRFIRRALS | LPRDAPT--- | RLADGTGRKP | RLLI ARHRT | 484 |
| SEQ_ID_NO_165 | FRSFLRDTYS | LRNDAVA--- | -TRQIRRRP  | RILA RGRS  | 380 |
| SEQ_ID_NO_167 | FRKFLRSSYS | LKKAMAT--- | KIRNGSKKRP | RLLI SRKRS | 318 |
| SEQ_ID_NO_168 | FTKFLRNVFA | LPRAGPMGVT | AGPSDGKKKP | RMMI SRRHP | 366 |
| SEQ_ID_NO_170 | FRQFLRRTYS | LKRAKAI--- | KIGDDARKRL | RLLI TRRKS | 301 |

| SEQ_ID_NO | | | | | | |
|---|---|---|---|---|---|---|
| SEQ_ID_NO_157 | FGNPAELMGM | HYKQYSISVD | ESSLTEQYPR | DHEIFKNPIA | 534 |
| SEQ_ID_NO_158 | FGNPAELMGL | HYKQYSIGVD | ESSLTEQYPR | DHEIFKNPIA | 534 |
| SEQ_ID_NO_160 | FGNPAELMGL | HYKQYSIGVD | ESSLTEQYPR | DHEIFKNPIA | 533 |
| SEQ_ID_NO_161 | FGNPAELMGL | HYKQYSIGVD | ESSLTEQYPS | DHEIFKNPIA | 533 |
| SEQ_ID_NO_162 | FGNPAELMGL | RYKQYAIGVD | ESSLTDQYPR | DHEIFKNPIS | 537 |
| SEQ_ID_NO_163 | FGNPSEMMGL | RYKQYAIGVH | ESSLTDHYPR | DHKIFKDPLS | 541 |
| SEQ_ID_NO_164 | YGDPAEALGL | RYMVQYEIGVD | ESSLKDKYPR | GHKIFTDPTS | 604 |
| SEQ_ID_NO_165 | FEKPSEGMNL | RYLEYKIAVE | ESTLVKKYGR | DHEIVRDPSA | 498 |
| SEQ_ID_NO_167 | FEEPAKGMNI | RYLDYKIRLE | ESTLIQQYPA | DHVLRDPSA | 436 |
| SEQ_ID_NO_168 | FGTPAVDMGL | KIYMSYSCGME | ESTLVDITLGR | DHPAVKDPES | 486 |
| SEQ_ID_NO_170 | FEQPAMDMEL | SIYLEYKIKAK | ESSLISKYKA | DHLTKDPLS | 421 |

| SEQ_ID_NO | | | | | | |
|---|---|---|---|---|---|---|
| SEQ_ID_NO_157 | FHKHGFDFIR | QTFMDKQNVK | LDCKRFRPIL | LEALDNLNP | 573 |
| SEQ_ID_NO_158 | FHKKGFDFIR | QTFMDKQNVK | LDCKRFRPIL | LEALDNLNP | 573 |
| SEQ_ID_NO_160 | FHKNGFDFIR | QTFMDKQNVK | LDCKRFRPIL | LEALDNLNP | 572 |
| SEQ_ID_NO_161 | FHKKGFDFIR | QTFMDKQNVK | LDCKRFRPIL | LEALDNLNA | 572 |
| SEQ_ID_NO_162 | FHQRGFEFIR | QTFMDKQNVK | LDCKRFRPVL | LEALDNLNP | 576 |
| SEQ_ID_NO_163 | FHKRGFEFIR | RTFMDKQNVR | LDCKRFRPVL | LEALDNLNQ | 580 |
| SEQ_ID_NO_164 | LHKKGFGFMR | RTLMDGQNIT | DLGRFRACS | - - SRR | 637 |
| SEQ_ID_NO_165 | VAKHGWEMFK | SVYLVQQNVS | DINRFKPVL | VKALELL- | 535 |
| SEQ_ID_NO_167 | MKQGVSAVE | SIYLRQQNVT | LNVNRFRPTL | VKALDLLHQ | 475 |
| SEQ_ID_NO_168 | HRSGWNKVA | EFYLGKQDVK | LDLQRFEPVL | LKAMAMLRE | 525 |
| SEQ_ID_NO_170 | VHKQGWDAVR | SIYLDKQNVK | LDIKRFRPTL | LKALQLLHQ | 460 |

| SEQ_ID_NO_280 | QKKYEEHPTV | DGTTVKVYQP | SHEEYQRSRN | RKHNMKALAE | 508 |
| --- | --- | --- | --- | --- | --- |
| SEQ_ID_NO_282 | QKKYDEQPAV | DGITVKVFQP | SHEEYQRSRN | KKHNMKALAE | 507 |
| SEQ_ID_NO_283 | QEKYDEQSAV | DGVSMRVFQP | SHEEYQRSKN | KGHNMKALAE | 507 |
| SEQ_ID_NO_284 | QKKYSEHPTV | DGTRVEVYQP | SHEEFQQTEK | KKHNRKAWAE | 436 |
| SEQ_ID_NO_285 | RNMYWEHPTM | GEVVGVYQP | SHEEYQQTEK | QMHNRKAWAE | 480 |
| SEQ_ID_NO_286 | RDMYWEHPTV | TGEVI GVYQP | SHEEYQQTEK | QNHNRKAWAE | 560 |
| SEQ_ID_NO_288 | KSMYWEYPTS | TGEVI GFYQP | SQEGYQQTEK | KMHNGKALAE | 452 |
| SEQ_ID_NO_289 | RDMYWEEPTE | TGEII GVHQP | SHEGYQQTQK | QFHNQKAWAE | 466 |
| SEQ_ID_NO_290 | KSMYWEQPTA | TGEVVGI YQP | SHEEYQQFGR | RSHDTKAWAE | 471 |
| SEQ_ID_NO_292 | | SGEDVGVHQP | | | 497 |

| SEQ_ID_NO_280 | IYLLSMNDEL | ITSGFSTFGY | AAQGLAGLKP | WMMFRSENH- | 547 |
| --- | --- | --- | --- | --- | --- |
| SEQ_ID_NO_282 | IYLLSMSDEL | ITSGFSTFGY | AAQGLAGLKP | WMMFKSENH- | 546 |
| SEQ_ID_NO_283 | IYLLSMTDVL | ITSGFSTFGY | AAQGLAGLKP | WMLKSENH- | 546 |
| SEQ_ID_NO_284 | IYLLSLTDVL | ITSAWSTFGY | AAQGLSGLRP | WMMFRSENH- | 475 |
| SEQ_ID_NO_285 | MYLLSLTDVL | VTSSWSTFGY | VAQGLGGLRP | WMLYKTEND- | 519 |
| SEQ_ID_NO_286 | MYLLSLTDVL | VTSSWSTFGY | VAQGSLGGLKP | WMLYKPENQ- | 599 |
| SEQ_ID_NO_288 | MYLLSLTDNL | VTSAWSTFGY | VAQGLGGLKP | WMLYRPENW- | 491 |
| SEQ_ID_NO_289 | MYLLSLTDVL | VTSSWSTFGY | VAQGLGGLKP | WMLYKPENR- | 505 |
| SEQ_ID_NO_290 | MYLLSLCDVL | VTSGWSTFGY | VAQGLAGVTP | WMMYRPLNFS | 510 |
| SEQ_ID_NO_292 | | | | | 537 |

| SEQ_ID_NO_280 | VTPDPPCGRV | MSIEPCFHQA | PFYDCKAKRD | TDLGKVVPYV | 587 |
| --- | --- | --- | --- | --- | --- |
| SEQ_ID_NO_282 | VMPDPPCGRA | MSIEPCFHQA | PFYDCKAKKD | ADLGKVVPYV | 586 |
| SEQ_ID_NO_283 | VTPDPPCVRA | MSIEPCFHQA | PFYDCKARKD | TDLGKVVPYV | 586 |
| SEQ_ID_NO_284 | AMPDPPCRRA | MSIEPCFHAP | PFYDCKAKRN | ADLGKMVPFM | 515 |
| SEQ_ID_NO_285 | TAPDPPCRRA | MSMEPCFHAP | PFYDCKAKKG | VDTGTLVPHV | 559 |
| SEQ_ID_NO_286 | TAPDPPCRRA | MSMEPCFHAP | PFYDCKAKKG | DTGAVVPHV | 639 |
| SEQ_ID_NO_288 | TTPDPSCGRA | MSMEPCFHSP | PFYDCKAKTG | DTGTLVPHV | 531 |
| SEQ_ID_NO_289 | TAPNPPCQRA | MSMEPCFHAP | PFYDCKAKRG | DTGALVPHV | 545 |
| SEQ_ID_NO_290 | EITPDPPCGRD | VSMEPCFHTP | PMYDCKLKHT | ADTARSVPHI | 550 |
| SEQ_ID_NO_292 | | | | | 577 |

Figure 10G

| SEQ ID NO | Sequence | Position |
|---|---|---|
| SEQ_ID_NO_280 | RHCEDVSWGL KI VN- --- --- KL | 605 |
| SEQ_ID_NO_282 | RHCEDVSWGL KI VN- --- QT HL | 604 |
| SEQ_ID_NO_283 | RHCEDVSWGL KI VD- --- QT HL | 604 |
| SEQ_ID_NO_284 | RHCEDVSWGL KVVN- --- QT QW | 533 |
| SEQ_ID_NO_285 | RHCEDI SWGL KVVD- --- DHD DL | 578 |
| SEQ_ID_NO_286 | RHCEDMSWGL KLVD BSX EHG AL | 661 |
| SEQ_ID_NO_288 | RHCEDMSWGL KLVD- --- NES EL | 550 |
| SEQ_ID_NO_289 | RHCEDI SWGL KLV-- --- --- --- | 558 |
| SEQ_ID_NO_290 | RHCEDMSWGL KLVD- --- --- -N | 565 |
| SEQ_ID_NO_292 | RRCEDVKMGL KLVG- --- --- PK | 593 |

Figure 11A

| SEQ_ID_NO | | | | | | | | |
|---|---|---|---|---|---|---|---|---|
| SEQ_ID_NO_641 | MRSLA- | ---- | ---- | ---- | VA-AM | ACLA- | AVARAGNFY | 24 |
| SEQ_ID_NO_643 | MRSTA- | ---- | -VL- | ---- | FVAV- | ACLA- | AVAHGGNFY | 25 |
| SEQ_ID_NO_645 | MRSEA- | ---- | -VF- | -VFLSA | VVAM- | LELA- | GTAQGGNFY | 28 |
| SEQ_ID_NO_646 | MRTVA- | ---- | -L-- | ---- | IVAM- | ACLV- | AIAHGGNFF | 24 |
| SEQ_ID_NO_647 | MRTVE- | ---- | -L-- | ---- | VAM- | ACLV- | AVARGGNFF | 24 |
| SEQ_ID_NO_648 | MRTVA- | ---- | -V-- | ---- | ILAM- | ACLV- | AVARGGNFF | 24 |
| SEQ_ID_NO_649 | MARMA- | ---- | ---- | -S-- | VLAI- | ASC- | AVAAASFD | 25 |
| SEQ_ID_NO_650 | MASSL- | ---- | ---- | -M-- | VLM- | LSFM- | XVVASAGNFN | 23 |
| SEQ_ID_NO_651 | MAPTCSSSSA | VSTALL | -M-- | ---- | SVV- | VSFL- | MAASAGNFY | 33 |
| SEQ_ID_NO_652 | MAM-- | ---- | -RF- | ---- | LVA- | QSLV- | ATASAGNFY | 22 |
| SEQ_ID_NO_653 | MASLL- | ---- | -F-- | ---- | VLA- | LSSV- | GIAVAGNFN | 23 |
| SEQ_ID_NO_654 | MAPPSF- | ---- | -SS- | ---- | LLF- | LSLLS | VSSVFCSNFY | 28 |

| SEQ_ID_NO | | | | | |
|---|---|---|---|---|---|
| SEQ_ID_NO_641 | QDTEMTWGG | RGKVVDGGRG | LDLTLDRTSG | SGFQSKSEYL | 64 |
| SEQ_ID_NO_643 | KDTEMTWGQG | RGKVVDGGRG | LDLTLDRTSG | SGFQSKSEYL | 65 |
| SEQ_ID_NO_645 | QDTEMTWGDG | RGKVVDGGRG | LDLTLDRSSG | SGFQSKSEYL | 68 |
| SEQ_ID_NO_646 | QDAEVSWGQG | RGKIVDGGRG | LDLTLDKTSG | SGFQSKSEYL | 64 |
| SEQ_ID_NO_647 | QDSEMSWGDG | RGKVVDGGRG | LDLTLDKTSG | SGFQSKTEYL | 64 |
| SEQ_ID_NO_648 | QDSEMTWGDG | RGKVVDGGRG | LDLTLDKTSG | SGFQSKREYL | 64 |
| SEQ_ID_NO_649 | KEFDITWGDG | RAKILNNGQL | LTLGLDKASG | SGFQSRNEYL | 65 |
| SEQ_ID_NO_650 | QDFDITWGDG | RGKILNNGQL | LTLSLDKPSG | SGFQSKNEYL | 63 |
| SEQ_ID_NO_651 | QDFDITWGDG | RAKNLDNGQL | LTLSLDKASG | SGFQSKNQYL | 73 |
| SEQ_ID_NO_652 | QEFDVTWGGD | RGKILNNGEL | LSLSLDKPSG | SGFESTHEYL | 62 |
| SEQ_ID_NO_653 | DDFKITWGDG | RGRIVDNGQL | LSLSLDKASG | SGFQSKNVYL | 63 |
| SEQ_ID_NO_654 | NDFEITWGND | RAKILNNGDL | LTLSLDRGSG | SGFQSKNVYL | 68 |

Figure 11B

| SEQ ID | Col 1 | Col 2 | Col 3 | Col 4 | Pos |
|---|---|---|---|---|---|
| SEQ_ID_NO_641 | FGKI DMQI KL | VPGNSAGTV | TTFYLSSQGS | THDEI DFEFL | 103 |
| SEQ_ID_NO_643 | FGKI DMQI KL | VPGNSAGTV | TTFYLSSQGP | THDEI DFEFL | 104 |
| SEQ_ID_NO_645 | FGKI DMQI KL | VPGNSAGTV | TTFYLSSQGD | AHDEI DFEFL | 107 |
| SEQ_ID_NO_646 | FGKI DMQI KL | VPGNSAGTV | TTFYLSSQGS | THDEI DFEFL | 103 |
| SEQ_ID_NO_647 | FGKI DMQI KL | VPGNSAGTV | TTFYLSSQGT | AHDEI DFEFL | 103 |
| SEQ_ID_NO_648 | FGKI DMQI KL | VPGNSAGTV | TTFYLSSQGT | AHDEI DFEFL | 103 |
| SEQ_ID_NO_649 | FGKI DMQI KL | VAGQLPPAPS | PPTTCRSMGA | THDEI DFEFL | 105 |
| SEQ_ID_NO_650 | FGKI DMQI KL | VPGNSAGTV | TAYYLSSQGP | THDEI DFEFL | 102 |
| SEQ_ID_NO_651 | FGKI DMQI KL | VPGNSAGTV | TAYYLSSQGP | THDEI DFEFL | 112 |
| SEQ_ID_NO_652 | FGKI DMQL KL | VPGNSAGTV | TAYYLSSQGP | THDEI DFEFL | 101 |
| SEQ_ID_NO_653 | FGKI DMQL KL | VPGNSAGTV | TAYYLSSQGS | THDEI DFEFL | 102 |
| SEQ_ID_NO_654 | YGKI DMQL KL | VPGNSAGTV | TTYYLKSQGS | TMDEI DFEFL | 107 |

| SEQ ID | Col 1 | Col 2 | Col 3 | Col 4 | Pos |
|---|---|---|---|---|---|
| SEQ_ID_NO_641 | GNVTGEPYTL | HTNVFTQGQG | QREQQFRLWF | DPTTAYHTYS | 143 |
| SEQ_ID_NO_643 | GNVSGEPYTL | HTNVFTQGQG | QREQQFRLWF | DPTHKDFHTYS | 144 |
| SEQ_ID_NO_645 | GNVSGEPYTL | HTNVFTRGQG | QREQQFRLWF | DPTTAFHTYS | 147 |
| SEQ_ID_NO_646 | GNVTGEPYTL | HTNVFTQGQG | QREQQFRLWF | DPTQSFHTYS | 143 |
| SEQ_ID_NO_647 | GNVTGEPYTL | HTNVFAQGQG | QREQQFRLWF | DPTKAFHTYS | 143 |
| SEQ_ID_NO_648 | GNVTGEPYTL | HTNVFAKGQG | KREQQFYLWF | DPTKAFHTYS | 143 |
| SEQ_ID_NO_649 | GNVTGEPYTL | HTNVFAKGQG | NREQQFYLWF | DPTKAFHTYS | 145 |
| SEQ_ID_NO_650 | GNLSGDPYIL | HTNVFSQGKG | NREQQFKLWF | DPTADFHTYS | 142 |
| SEQ_ID_NO_651 | GNLSGDPYIL | HTNVFSQGKG | NREQQFKLWF | DPTADFHTYS | 152 |
| SEQ_ID_NO_652 | GNLSGDPYTL | HTNVFTQGKG | NREMQFHLWF | DPTEDFHTYS | 141 |
| SEQ_ID_NO_653 | GNPSGDPYTL | HTNVFTQGKG | NREQQFHLWF | DPTKDFHTYS | 142 |
| SEQ_ID_NO_654 | GNLSGDPYTL | HTNVYTQGKG | DREQQFHLWF | DPTSDFHTYS | 147 |

Figure 11C

| SEQ ID NO | Sequence | Position |
|---|---|---|
| SEQ_ID_NO_641 | VWNPQHIIF AVDGTPIRDF KNHEAHGVAF PKSQPMRLYA | 183 |
| SEQ_ID_NO_643 | VVWNPQHVIF AVDGTPIRDF KNHEARGVGF PRTQPMRLYA | 184 |
| SEQ_ID_NO_645 | IWNPQHVIF AVDGTPVRDF KNHEARGVAF PRMQPMRLYA | 187 |
| SEQ_ID_NO_646 | IWNPQHVIF AVDGTPIRDF KNHEARGVAF PKSQPMRVYA | 183 |
| SEQ_ID_NO_647 | IWNPQHVIF AVDGTPIRDF KNHEARGVSF PKSQPMRLYA | 183 |
| SEQ_ID_NO_648 | VWNPQHVIF AVDGTAIRDF KNHEARGVAF PKSQPMRLYA | 183 |
| SEQ_ID_NO_649 | IWNPQRIIF AVDGTAIREF KNHEARGVSF PKNQPMRLYA | 185 |
| SEQ_ID_NO_650 | IWNPQRIIF AVDGTPIREF KNSESIGVSY PKNQPMRIYS | 182 |
| SEQ_ID_NO_651 | IWNPQRHVIF SVDGTPIRDF KNSESIGVPY PKSQPMRIYS | 192 |
| SEQ_ID_NO_652 | IWNPSHIIF SVDGTPIRDF KNLESRGIAF PNSQPMKIYS | 181 |
| SEQ_ID_NO_653 | IWNPQGLIF MVDGIPIRDF KNMESRGVAF PKSQPMRLYS | 182 |
| SEQ_ID_NO_654 | LWNPQGLIF SVDGTPIRKF KNHESSGVLF PKKQPMRLYS | 187 |

| SEQ ID NO | Sequence | Position |
|---|---|---|
| SEQ_ID_NO_641 | SLWNADDWAT QGGRVKADWS HAPFVASFRG FRADACVWSG | 223 |
| SEQ_ID_NO_643 | SLWNADDWAT QGGRVKADWT QAPFVASFRG FSADACVWDG | 224 |
| SEQ_ID_NO_645 | SLWNADDWAT QGGRVKADWS KAPFVASFRG FSADACVWAN | 227 |
| SEQ_ID_NO_646 | SLWNADDWAT QGGRVKADWS KAPFVASFRD FNADACVWSN | 223 |
| SEQ_ID_NO_647 | SLWNADDWAT QGGRVKTDWS KAPFVASFRN FNADACVMSG | 223 |
| SEQ_ID_NO_648 | SLWNADDWAT QGGRVKTDWS KAPFVASFRG FSADACVWSG | 223 |
| SEQ_ID_NO_649 | SLWNADDWAT QGGRVKTDWS KAPFTASYRN FNADACIWSS | 225 |
| SEQ_ID_NO_650 | SLWNADDWAT RGGLVKTDWS QAPFTASYRN FNANACLWSS | 222 |
| SEQ_ID_NO_651 | SLWNADDWAT RGGLVKTDWS QAPFTASYRN FNADACVWSS | 232 |
| SEQ_ID_NO_652 | SLWNADDWAT RGGLIKTDWT KAPFTASYRN FKADTCVPSS | 221 |
| SEQ_ID_NO_653 | SLWNADDWAT RGGLVKTDWT KAPFTASYRN FNANACVWSA | 222 |
| SEQ_ID_NO_654 | SLWNADDWAT RGGLVKTDWS KAPFTASYRN FNADVCVWSG | 227 |

Figure 11D

| SEQ ID NO | | | | | | | |
|---|---|---|---|---|---|---|---|
| SEQ_ID_NO_641 | GRQQCPVGTM | EAAA- | ---- | RGWMSQ | QLSDTSYRRM | 253 |
| SEQ_ID_NO_643 | GKQQCPVGTM | AAAAT- | -GGR | GSWWNQ | QLSDMSYRRM | 262 |
| SEQ_ID_NO_645 | GRQRCPEGTM | EAAAV- | -AGA | RGGP | QLSDMSYRRM | 264 |
| SEQ_ID_NO_646 | GRQRCPVGTM | ETVAAPA | PAGGR | GSRGWWNQ | ELSGMGYRRM | 263 |
| SEQ_ID_NO_647 | GAQRCPAGTM | EASAA- | ---- | RGGAGGWWNQ | ELSGMGYRRM | 256 |
| SEQ_ID_NO_648 | GAQRCPAGTM | EASAA- | ---- | GGGSVWWNQ | ELSGMGYRRM | 257 |
| SEQ_ID_NO_649 | GAQRCPAGTM | DASG- | ---- | GGSGSVWWNQ | ELDSTSQERM | 257 |
| SEQ_ID_NO_650 | GASSCSSTTP | SSTS- | ---- | TGSSGWYSQ | ELDSTSQERM | 254 |
| SEQ_ID_NO_651 | GSSSCSSTSP | SSTS- | ---- | TSGQWYSQ | ELDSTSQERM | 264 |
| SEQ_ID_NO_652 | AITECASNSV | P--- | ---- | TNGGWWNQ | ELDSMGQQRM | 250 |
| SEQ_ID_NO_653 | GTSITCSSKKS | PSAS- | ---- | SNGGWMNE | NLDTTRQQRM | 254 |
| SEQ_ID_NO_654 | GVSSCSSGGN | V--- | ---- | GGRGWLSE | | 256 |

| SEQ ID NO | | | | | | | |
|---|---|---|---|---|---|---|---|
| SEQ_ID_NO_641 | RWQRKFMIY | NYCTDAKRFP | QGVPAECHL | ---R | 283 |
| SEQ_ID_NO_643 | RWQRKFMIY | NYCTDAKRFP | QGVPAECKL | ---R | 292 |
| SEQ_ID_NO_645 | RWQRKFMIY | NYCADAKRFP | QGVPAECKL | ---R | 294 |
| SEQ_ID_NO_646 | RWQRKFMIY | NYCTDPKRFP | QGTPAECKL | ---R | 293 |
| SEQ_ID_NO_647 | RWQRKFMIY | NYCTDPKRFP | QGVPAECKL | ---R | 286 |
| SEQ_ID_NO_648 | RWQRKFMIY | NYCTDPKRVA | QGVPAECKL | ---R | 287 |
| SEQ_ID_NO_649 | RWQKNYMIY | NYCTDPKRVA | EGLPAECKIR | | 291 |
| SEQ_ID_NO_650 | RWQKNYMIY | NYCTDTKRFP | QGLPPECITAT | LRSK | 287 |
| SEQ_ID_NO_651 | KWQKNYMIY | NYCADTKRFP | QGLPPECSAT | TLS | 297 |
| SEQ_ID_NO_652 | KWQKNYMIY | NYCSDLKRFP | QGLPPECSIF | TMS | 280 |
| SEQ_ID_NO_653 | KWQKNYMIY | NYCADLKRFS | QGLPPECSF- | --VA | 284 |
| SEQ_ID_NO_654 | RWQRNYMIY | NYCTDAKRFP | QGYPPECAIL | --AP | 287 |

Figure 12

TRANSGENIC PLANTS HAVING ALTERED BIOMASS COMPOSITION

CROSS-REFERENCE TO RELATED APPLICATION

This application is a divisional of U.S. patent application Ser. No. 16/593,082, filed Oct. 4, 1019, which is a divisional of U.S. patent application Ser. No. 15/717,773, filed Sep. 27, 2017, which is a divisional of U.S. patent application Ser. No. 13/828,225, filed Mar. 14, 2013, (now U.S. Pat. No. 9,828,608, issued Nov. 28, 2017), which is a continuation-in-part of International Application No. PCT/US2011/057709, filed Oct. 25, 2011, which claims the benefit of U.S. Provisional Application No. 61/407,280, filed Oct. 27, 2010. The contents of the foregoing applications are hereby incorporated by reference in their entireties.

INCORPORATION OF SEQUENCE LISTING

The sequence listing that is contained in the file named "CRES027USCP1D3 ST26.xml," which is 2402 KB (as measured in Microsoft Windows®) and was created on Apr. 4, 2023 and comprises 823 sequences, is incorporated herein by reference in its entirety.

STATEMENT AS TO FEDERALLY SPONSORED RESEARCH

This invention was made with government support under USDA Biomass Research and Development Initiative Grant 68-3A75-7-601 and 68-3A75-6-501. The government has certain rights in the invention. The material in the accompanying sequence listing is hereby incorporated by reference into this application.

TECHNICAL FIELD

This document relates to methods and materials involved in modulating biomass composition in plants. For example, this document provides plants having altered sucrose or conversion efficiency, as well as materials and methods for making plants and plant products having altered sucrose or conversion efficiency.

BACKGROUND

Plants store energy from sunlight in the form of chemical bonds that compose plants. The energy stored in plant materials can be converted to forms of energy such as heat, electricity and liquid fuels, depending upon the plant material employed and the process applied to extract energy from it. Other processes can produce chemical intermediates from plant biomass that are useful in a variety of industrial processes, for instance lactic acid, succinic acid, etc.

Plant materials have been used for millennia by humans to generate heat by direct combustion in air. For building and process heating purposes, this heat is typically used to generate steam, which is a more transportable heat source used to heat buildings and public areas using heat exchangers of various design. The production of steam may also be used to drive turbines, which transform heat energy into electrical energy. These processes typically involve a simple, direct combustion process of the plant material alone, or a co-firing process with coal or other energy source.

Fuels such as ethanol can be produced from plant materials by a number of different processes. For example, the sucrose in sugarcane can be extracted from the plant material and directly fermented to ethanol using a microorganism, such as brewer's yeast. Brazil has converted a significant portion of its transportation sector over to ethanol derived from sugarcane, proving this can be done on a very large scale over broad geography. As another example, the starch from corn can be processed using $\alpha$-amylase and glucoamylase to liberate free glucose that is subsequently fermented to ethanol. The US uses a significant portion of its corn crop to produce ethanol from starch. While these advances are significant, the ability to increase the amount of liquid transportation fuel obtained from plant material is limited and insufficient to achieve federally mandated renewable energy targets because only a small fraction of the solar energy captured and transformed into chemical energy in plants is converted into biofuels in these industrial processes.

Plant material can be used for the production of cellulosic biofuels by biochemical processes employing enzymes and/or microorganisms or by thermochemical processes such as Biomass to Liquids (BtL) technology using high temperature and non-enzymatic catalysts. There are also examples of hybrid thermochemical/biochemical processes. Biochemical processes typically employ physical and chemical pretreatments, enzymes, and microorganisms to deconstruct the lignocellulose matrix of biomass in order to liberate the fermentable from cellulose, hemicellulose, and other cell wall carbohydrates, which are subsequently fermented to ethanol by a microorganism. Currently, many different processing methods are being developed for biofuel production that employ different strategies for pretreatment, enzyme cocktails, and microorganisms. Many of these processes are focused on the production of ethanol, but butanol and other useful molecules (e.g., lactic acid, succinic acid, polyalkanoates, etc.) can also be produced in this type of process. The conversion product molecule produced is usually defined by the microorganisms selected for fermentation.

Thermochemical processes employ very high temperatures in a low oxygen (i.e., $O_2$) environment to completely degrade the organic constituents of biomass to syngas, largely composed of molecular hydrogen ($H_2$) and carbon monoxide (CO) gas. These simple molecules are then re-formed into more useful and valuable molecules (fuels or chemical intermediates) utilizing a Fischer-Tropsch process or other methods usually employing a chemical catalyst of some sort. These processes are effective at producing biofuels that are similar to current petrochemical-based hydrocarbon fuels (i.e., gasoline, diesel, jet fuel), although other biofuel molecules can also be produced in these types of processes (i.e., ethanol, butanol, kerosene).

A variant form of thermochemical process uses pyrolysis (i.e., thermal degradation in the complete absence of oxygen) to partially degrade the organic constituents present in plant biomass to a chemically heterogeneous liquid bio-oil. This serves to increase the energy density of the biomass to facilitate transport to centralized processing facilities where the bio-oil is further processed to a desired product slate.

The economic viability of biomass conversion processes is significantly impacted by the composition of the plant material and its conversion efficiency to heat, electricity, biofuels or chemical intermediates under specific processing conditions. For biochemical processes producing biofuels or other chemicals, the recalcitrance of the lignocellulose matrix of the biomass is a major factor in conversion efficiency.

SUMMARY

The present invention relates to methods of altering biomass composition in plants and plants generated thereby. Plants having altered biomass composition are useful for agriculture, forage, horticulture, biomass to energy conversion, paper production, plant product production, and other industries. For example, this document features dedicated energy crops such as *Panicum virgatum* L. (switchgrass), *Miscanthus* x gigantus (*Miscanthus*), *Sorghum* sp., and *Saccharum* sp. (sugar cane) having altered biomass composition.

This document features a method of producing a plant. The method includes growing a plant cell comprising an exogenous nucleic acid. The exogenous nucleic acid includes a regulatory region operably linked to a nucleotide sequence encoding a polypeptide, where the HMM bit score of the amino acid sequence of the polypeptide is greater than about 65, based on the HMM of the amino acid sequences depicted in one of FIGS. 1-12. A plant produced from the plant cell has a difference in biomass composition compared to the corresponding composition of a control plant that does not comprise the nucleic acid. The difference in biomass composition in the plant can be a difference in the sucrose content or conversion efficiency.

This document also features a method of producing a plant that includes growing a plant cell comprising an exogenous nucleic acid. The exogenous nucleic acid comprises a regulatory region operably linked to a nucleotide sequence encoding a polypeptide having 80 percent or greater sequence identity to an amino acid sequence selected from the group consisting of SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823. A plant produced from the plant cell has a difference in biomass composition as compared to the corresponding composition of a control plant that does not comprise the nucleic acid. The difference in biomass composition in the plant can be a difference in the sucrose content or conversion efficiency.

In another aspect, this document features a method of producing a plant. The method includes growing a plant cell comprising an exogenous nucleic acid, where the exogenous nucleic acid includes a regulatory region operably linked to a nucleotide sequence having 80 percent or greater sequence identity to a nucleotide sequence selected from the group consisting of SEQ ID NO: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, or a fragment thereof. A plant produced from the plant cell has a difference in biomass composition as compared to the corresponding composition of a control plant that does not include the nucleic acid. The difference in biomass composition in the plant can be a difference in the sucrose content or conversion efficiency.

This document also features a method of producing a plant that includes growing a plant cell comprising an exogenous nucleic acid. The exogenous nucleic acid is effective for down regulating an endogenous nucleic acid in the plant cell, wherein the endogenous nucleic acid encodes a polypeptide, and wherein the HMM bit score of the amino acid sequence of the polypeptide is greater than about 65, where the HMM is based on the amino acid sequences depicted in one of FIGS. 1-12.

In another aspect, this document features a method of modulating biomass composition in a plant. The method includes introducing into a plant cell an exogenous nucleic acid, the exogenous nucleic acid comprising a regulatory region operably linked to a nucleotide sequence encoding a polypeptide, wherein the HMM bit score of the amino acid sequence of the polypeptide is greater than about 65, where the HMM is based on the amino acid sequences depicted in one of FIGS. 1-12, and wherein a plant produced from the plant cell has a difference in biomass composition as compared to the corresponding composition of a control plant that does not comprise the exogenous nucleic acid. The difference in biomass composition in the plant can be a difference in the sucrose content or conversion efficiency.

A method of modulating biomass composition in a plant also is featured. The method includes introducing into a plant cell an exogenous nucleic acid, the exogenous nucleic acid comprising a regulatory region operably linked to a nucleotide sequence encoding a polypeptide having 80 percent or greater sequence identity to an amino acid sequence selected from the group consisting of SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823. A plant produced from the plant cell has a difference in biomass composition as compared to the corresponding composition of a control plant that does not include the nucleic acid. The difference in biomass composition in the plant can be a difference in the sucrose content or conversion efficiency.

In the methods described herein, the polypeptide can include a heavy-metal-associated domain having 60 percent or greater sequence identity to residues 6 to 73 of SEQ ID NO: 562. The polypeptide can include a Myb-like DNA-binding domain having 60 percent or greater sequence identity to residues 212 to 263 of SEQ ID NO: 246. The polypeptide can include a DUF1070 domain having 60 percent or greater sequence identity to residues 4-52 of SEQ ID NO: 111. The polypeptide can include a glycosyl hydrolase family 16 domain and a xyloglucan endo-transglycosylase (XET) domain having 60 percent or greater sequence identity to residues 39 to 224 and 246 to 292 of SEQ ID NO: 348, respectively. The polypeptide can include an Alpha-L-AF_C domain having 60 percent or greater sequence identity to residues 454 to 643 of SEQ ID NO: 774 and a CBM_4_9 domain having 60 percent or greater sequence identity to residues 71 to 229 of SEQ ID NO: 774. The polypeptide can include a COBRA domain having 60 percent or greater sequence identity to residues 45 to 209 of SEQ ID NO: 416. The polypeptide can include a glycosyl transferase family 8 domain having 60 percent or greater sequence identity to residues 30 to 253 of SEQ ID NO: 2. The polypeptide can include a DUF563 domain having 60 percent or greater sequence identity to residues 196 to 439 of SEQ ID NO: 157. The polypeptide can include an XG_FTase domain having 60 percent or greater sequence identity to residues 72 to 574 of SEQ ID NO: 280. The polypeptide can include a glycosyl hydrolase family 16 domain having 60 percent or greater sequence identity to residues 23 to 204 of SEQ ID NO: 641 and a XET domain having 60 percent or greater sequence identity to residues 228 to 280 of SEQ ID NO: 641. The polypeptide can include a potato inhibitor I family domain having 60 percent or greater sequence identity to residues 17 to 76 of SEQ ID NO: 26.

In the methods described herein, the polypeptide can be selected from the group consisting of SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823.

This document also features a method of modulating the biomass composition in a plant. The method includes introducing into a plant cell an exogenous nucleic acid, the exogenous nucleic acid comprising a regulatory region operably linked to a nucleotide sequence having 80 percent or greater sequence identity to a nucleotide sequence selected from the group consisting of SEQ ID NO: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, or a fragment thereof. A plant produced from the plant cell has a difference in biomass composition as compared to the corresponding composition of a control plant that does not comprise the nucleic acid. The difference in biomass composition in the plant can be a difference in the sucrose content or conversion efficiency.

In another aspect, this document features a plant cell that includes an exogenous nucleic acid. The exogenous nucleic acid includes a regulatory region operably linked to a nucleotide sequence encoding a polypeptide, wherein the HMM bit score of the amino acid sequence of the polypeptide is greater than about 65, where the HMM is based on the amino acid sequences depicted in one of FIGS. 1-12, and wherein a plant produced from the plant cell has a difference in biomass composition as compared to the corresponding composition of a control plant that does not comprise the nucleic acid. The difference in biomass composition in the plant can be a difference in the sucrose content or conversion efficiency.

This document also features a plant cell that includes an exogenous nucleic acid, where the exogenous nucleic acid includes a regulatory region operably linked to a nucleotide sequence encoding a polypeptide having 80 percent or greater sequence identity to an amino acid sequence selected from the group consisting of SEQ ID NO: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823, wherein a plant produced from the plant cell has a difference in biomass composition as compared to the corresponding composition of a control plant that does not comprise the nucleic acid. The difference in biomass composition in the plant can be a difference in the sucrose content or conversion efficiency.

In yet another aspect, this document features a plant cell that includes an exogenous nucleic acid. The exogenous nucleic acid includes a regulatory region operably linked to a nucleotide sequence having 80 percent or greater sequence identity to a nucleotide sequence selected from the group consisting of SEQ ID NO: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, or a fragment thereof, wherein a plant produced from the plant cell has a difference in biomass composition as compared to the corresponding composition of a control plant that does not comprise the nucleic acid. The difference in biomass composition in the plant can be a difference in the sucrose content or conversion efficiency.

This document also features a transgenic plant comprising any of the plant cells described herein. The plant can be a member of a species selected from the group consisting of *Panicum virgatum* (switchgrass), *Sorghum bicolor* (Sorghum, sudangrass), *Miscanthus giganteus* (Miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), and *Pennisetum glaucum* (pearl millet). A transgenic plant can include a polypeptide selected from the group consisting of SEQ ID NO: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823. A seed product can include embryonic tissue from a transgenic plant described herein.

This document also features an isolated nucleic acid that includes a nucleotide sequence having 85% or greater sequence identity to the nucleotide sequence set forth in SEQ ID NO: 9, 13, 16, 23, 166, 169, 186, 198, 212, 219, 229, 231, 235, 265, 267, 269, 287, 307, 313, 322, 324, 330, 332, 334, 341, 343, 354, 356, 385, 387, 389, 395, 401, 411, 542, 550, 553, 558, 571, 579, 585, 591, 593, 597, 600, 606, 614, 618, 623, 628, 631, 635, or 637.

In another aspect, an isolated nucleic acid is featured that includes a nucleotide sequence encoding a polypeptide having 80% or greater sequence identity to the amino acid sequence set forth in SEQ ID NO: 8, 10, 14, 15, 17, 21, 22, 24, 57, 167, 170, 187, 213, 220, 230, 232, 236, 266, 268, 270, 285, 286, 288, 290, 295, 296, 297, 299, 308, 309, 310, 311, 314, 317, 318, 323, 325, 327, 329, 331, 333, 335, 338, 342, 344, 355, 357, 360, 362, 363, 364, 366, 374, 377, 381, 386, 388, 390, 392, 393, 394, 396, 402, 408, 412, 413, 414, 493, 543, 551, 554, 557, 559, 572, 573, 574, 575, 586, 589, 590, 592, 594, 598, 599, 601, 602, 603, 607, 609, 615, 619, 622, 624, 625, 629, 630, 632, 636, 638, 776, 814, 815, 816, 817, 818, 819, 820, or 821.

This document also features a method of identifying whether a polymorphism is associated with variation in a trait. The method includes determining whether one or more genetic polymorphisms in a population of plants is associated with the locus for a polypeptide selected from the group consisting of the polypeptides depicted in FIGS. 1-12 and functional homologs thereof; and measuring the correlation between variation in the trait in plants of the population and the presence of one or more genetic polymorphisms in plants of the population, thereby identifying whether or not the one or more genetic polymorphisms are associated with variation in the trait. The variation in biomass composition can be a variation in sucrose content or conversion efficiency. The population can be a population of switchgrass plants.

In another aspect, this document features a method of making a plant line. The method includes determining whether one or more genetic polymorphisms in a population of plants is associated with the locus for a polypeptide selected from the group consisting of the polypeptides depicted in FIGS. 1-12 and functional homologs thereof; identifying one or more plants in the population in which the presence of at least one of the genetic polymorphisms is associated with variation in biomass composition; crossing one or more of the identified plants with itself or a different plant to produce seed; crossing at least one progeny plant grown from the seed with itself or a different plant; and repeating the crossing steps for an additional 0-5 generations to make the plant line, wherein at least one of the genetic polymorphisms is present in the plant line. The variation in biomass composition can be a variation in sucrose content or conversion efficiency. The population can be a population of switchgrass plants.

This document also features a method of altering biomass composition in a plant. The method includes modifying an endogenous biomass composition-modulating nucleic acid, the nucleic acid comprising a nucleotide sequence with an open reading frame having 80 percent or greater (e.g., 90 percent or greater, or 95 percent or greater) sequence identity to the nucleotide sequence selected from the group consisting of SEQ ID NO: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, wherein the plant has a difference in biomass composition as compared to the corresponding composition of a control plant where the nucleic acid has not been modified. The modification can be effected by introducing a genetic modification in the locus comprising the nucleic acid. The method further can include selecting for plants having altered biomass composition. The endogenous nucleic acid can encode a polypeptide having 80 percent or greater (e.g., 90 percent or greater, or 95 percent or greater) sequence identity to an amino acid sequence selected from the group consisting of SEQ ID NO: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823.

This document also features a method of producing a plant. The method includes growing a plant cell containing a modified endogenous nucleic acid encoding a polypeptide, wherein the HMM bit score of the amino acid sequence of the polypeptide is greater than about 65, the HMM based on the amino acid sequences depicted in one of FIGS. 1-12, and wherein the plant has a difference in biomass composition as compared to the corresponding composition of a control plant where the nucleic acid has not been modified.

In another aspect, this document features a plant cell containing a modified endogenous nucleic acid encoding a polypeptide, wherein the HMM bit score of the amino acid sequence of the polypeptide is greater than about 65, the HMM based on the amino acid sequences depicted in one of FIGS. 1-12, and wherein a plant produced from the plant cell has a difference in biomass composition as compared to the corresponding composition of a control plant where the nucleic acid has not been modified.

In yet another aspect, this document features a plant cell containing a modified biomass composition-modulating endogenous nucleic acid. The nucleic acid includes a nucleotide sequence with an open reading frame having 80 percent or greater sequence identity to the nucleotide sequence selected from the group consisting of SEQ ID NO: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, and wherein a plant produced from the plant cell has a difference in biomass composition as compared to the corresponding composition of a control plant where the nucleic acid has not been modified. The difference in biomass composition in the plant can be a difference in the sucrose content or conversion efficiency.

An endogenous nucleic acid can encode a polypeptide having 80 percent or greater sequence identity to an amino acid sequence selected from the group consisting of SEQ ID NO: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823, and wherein a plant produced from the plant cell has a difference in biomass composition as compared to the corresponding composition of a control plant where the nucleic acid has not been modified. The difference in biomass composition in the plant can be a difference in the sucrose content or conversion efficiency.

This document also features a plant cell that includes an exogenous nucleic acid, the exogenous nucleic acid encoding a polypeptide having E.C. 3.2.1.55 activity, and wherein a plant produced from the plant cell has a difference in biomass composition as compared to the corresponding level of a control plant that does not comprise said nucleic acid. The difference in biomass composition in the plant can be a difference in the sucrose content or conversion efficiency.

In another aspect, this document features a method of modulating biomass composition of a plant. The method includes introducing into a plant cell an exogenous nucleic acid, the exogenous nucleic acid encoding a polypeptide having E.C. 3.2.1.55 activity.

This document also features a process for making a biofuel. The process includes planting seeds of a *Sorghum* plant described herein, or a *Sorghum* plant produced by a method described herein in one or more fields to obtain at least about 10 acres of the *Sorghum* plants; harvesting *Sorghum* from the one or more fields to obtain harvested *Sorghum* biomass; extracting *Sorghum* stem juice from the harvested *Sorghum* biomass to obtain extracted stem juice comprising sugar; using said sugar of the extracted stem juice in a fermentation reaction to produce a fermentation product comprising a biofuel; and isolating the biofuel from the fermentation product to obtain a composition comprising the biofuel (e.g., ethanol or anhydrous ethanol). The *Sorghum* plants can have an average BRIX value that is greater than about 10 percent at harvest time.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

DESCRIPTION OF DRAWINGS

FIG. 1 is an alignment of the amino acid sequence of CeresClone:1767521 (SEQ ID NO: 483) with homologous and/or orthologous amino acid sequences. In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIGS. 2A-2C are an alignment of the amino acid sequence of CeresClone: 1871180 (SEQ ID NO: 562) with homologous and/or orthologous amino acid sequences.

FIGS. 3A-3C are an alignment of the amino acid sequence of CeresClone: 240112 (SEQ ID NO: 246) with homologous and/or orthologous amino acid sequences.

FIG. 4 is an alignment of the amino acid sequence of CeresClone: 1764605 (SEQ ID NO:111) with homologous and/or orthologous amino acid sequences.

FIGS. 5A-5E are an alignment of the amino acid sequence of CeresClone: 1776501 (SEQ ID NO: 348) with homologous and/or orthologous amino acid sequences.

FIGS. 6A-6I are an alignment of the amino acid sequence of CeresClone: 1789981 (SEQ ID NO: 774) with homologous and/or orthologous amino acid sequences.

FIGS. 7A-7G are an alignment of the amino acid sequence of CeresClone: 1804732 (SEQ ID NO: 416) with homologous and/or orthologous amino acid sequences.

FIGS. 8A-8E are an alignment of the amino acid sequence of CeresClone: 1807011 (SEQ ID NO: 2) with homologous and/or orthologous amino acid sequences.

FIGS. 9A-9I are an alignment of the amino acid sequence of CeresClone: 1888614 (SEQ ID NO: 157) with homologous and/or orthologous amino acid sequences.

Figure 10A:
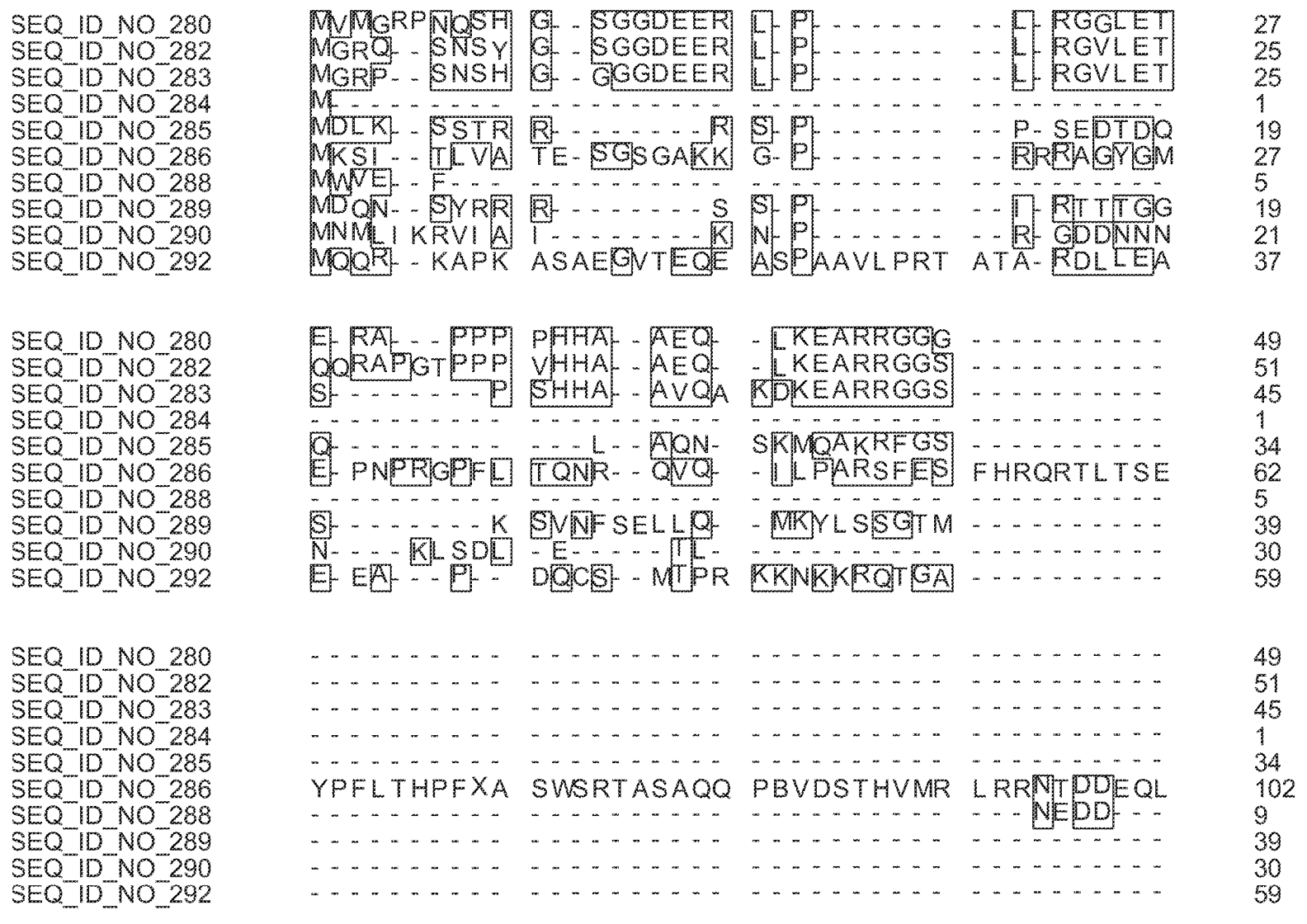
Figure 10B:
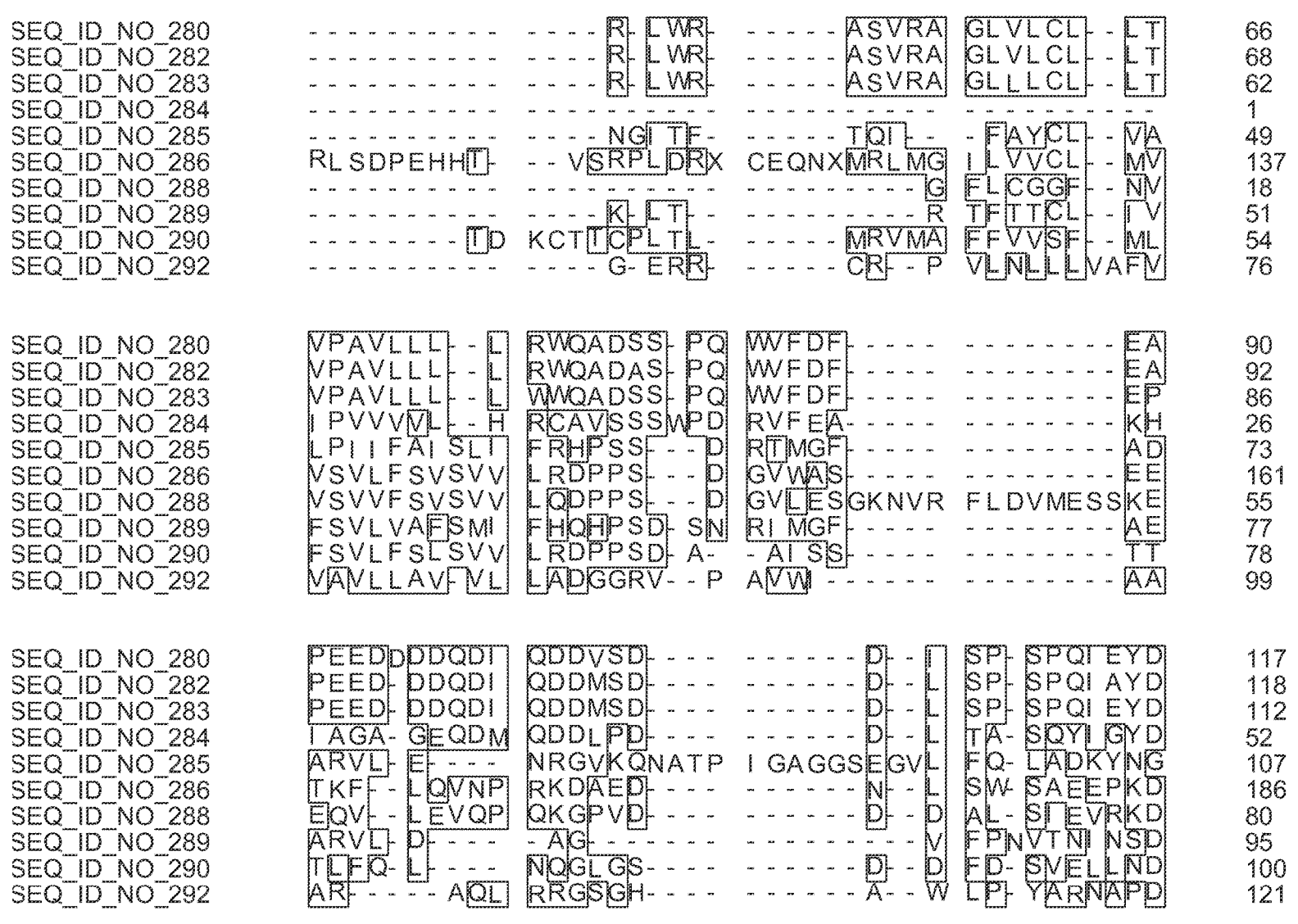
Figure 10C:
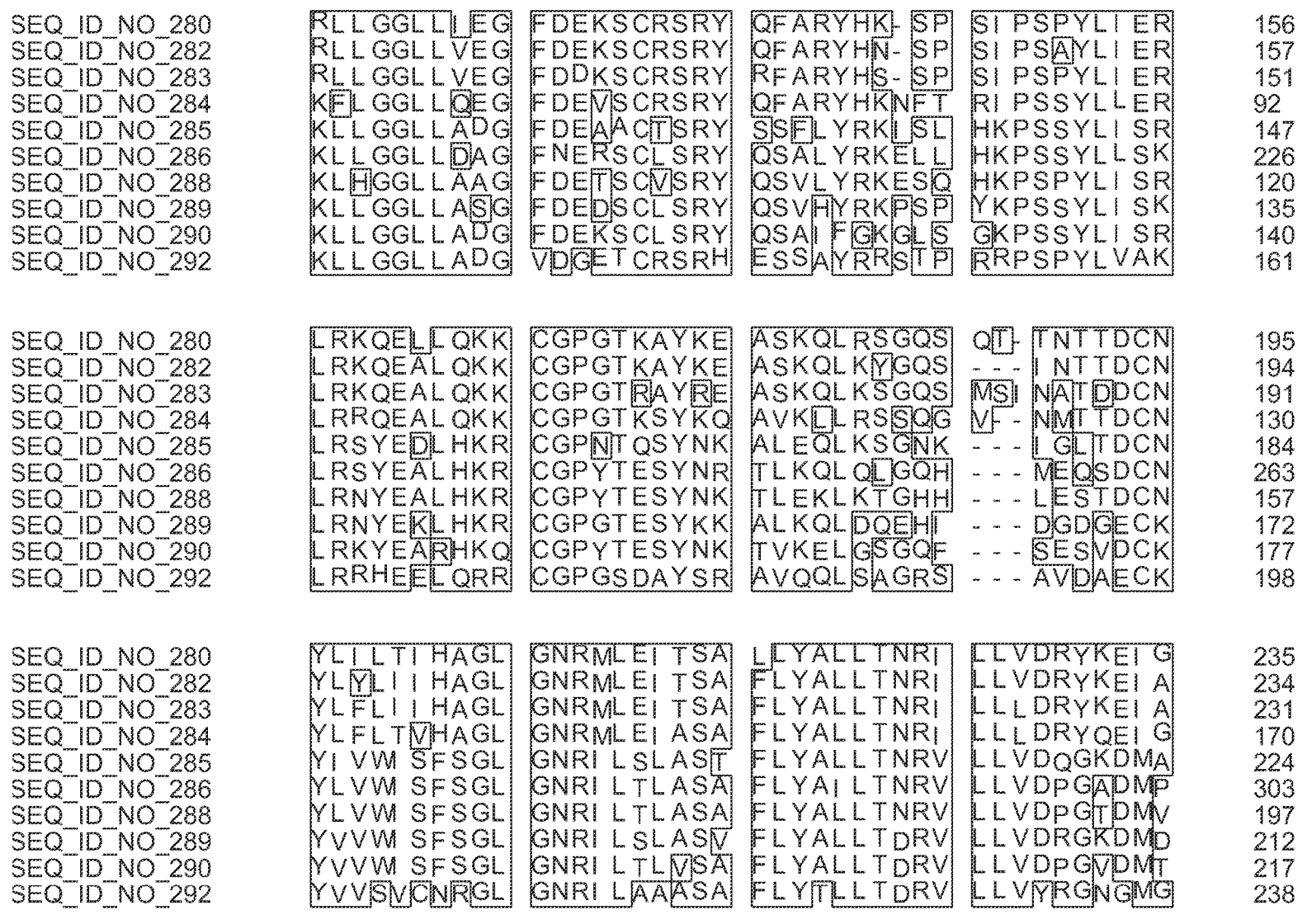
Figure 10E:
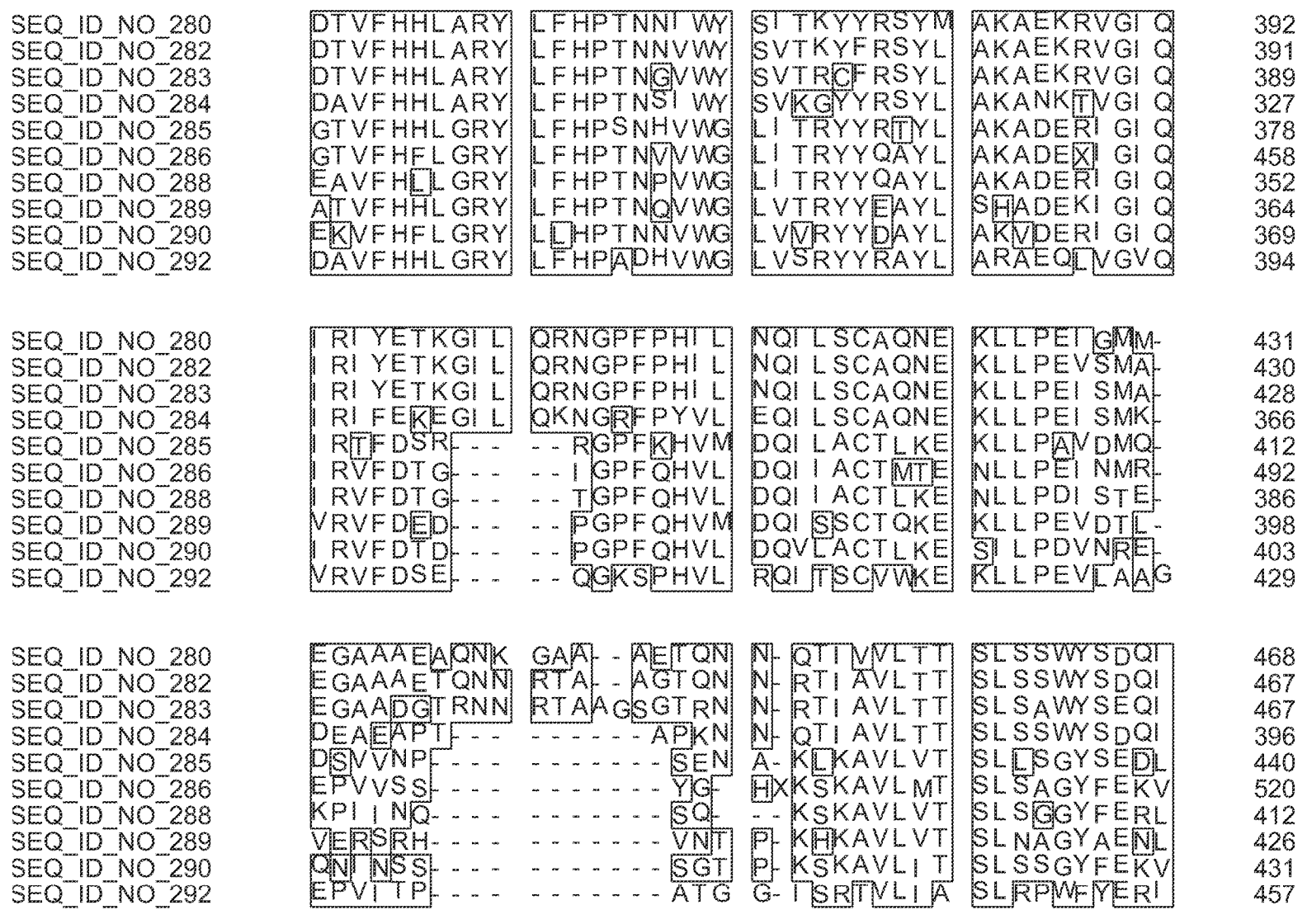

FIGS. 10A-10G are an alignment of the amino acid sequence of CeresClone: 1900192 (SEQ ID NO:280) with homologous and/or orthologous amino acid sequences.

FIGS. 11A-11D are an alignment of the amino acid sequence of CeresClone: 1955550 (SEQ ID NO: 641) with homologous and/or orthologous amino acid sequences.

FIG. 12 is an alignment of the amino acid sequence of CeresClone:1955766 (SEQ ID NO: 26) with homologous and/or orthologous amino acid sequences.

DETAILED DESCRIPTION

This document features methods and materials related to modulating biomass composition (e.g., sucrose content or conversion efficiency) in plants. For example, this document features methods and materials for increasing or decreasing sucrose content and conversion efficiency in plants. In some embodiments, the plants also may have modulated levels of, for example, lignin, modified root architecture, modified herbicide resistance, or modified carotenoid biosynthesis. The methods can include transforming a plant cell with a nucleic acid encoding a biomass composition-modulating polypeptide, wherein expression of the polypeptide results in modulated biomass composition. Plant cells produced using such methods can be grown to produce plants having an increased or decreased sucrose content and/or conversion efficiency. Such plants may produce more grazable forage. Increased brix levels (an approximate amount of sugar as measured by, for example, a digital refractometer) and/or sucrose content can result in increased palatability as a forage crop. In addition, such plants, and the seeds of such plants, may be used to produce, for example, switchgrass, *Miscanthus, Sorghum* sp., and sugar cane plants having increased value as a biofuel feedstock.

I. Definitions

"Accessible Carbohydrate" refers to mono- and oligosaccharides released into the aqueous phase after processing of a biomass feedstock. The amount of accessible carbohydrate in a feedstock is related to the pretreatment and enzymatic saccharification conditions chosen for the saccharification process and to the composition and structure of the initial biomass feedstock.

"Amino acid" refers to one of the twenty biologically occurring amino acids and to synthetic amino acids, including D/L optical isomers.

"Ash" refers to inorganic material that contributes to the dry weight of the feedstock. Ash content in biomass feedstocks can be determined using published, standard methods such as ASTM Standard E1755.

"Biofuels" include, but are not limited to, biodiesel, methanol, ethanol, butanol, linear alkanes ($C_5$-$C_{20}$), branched-chain alkanes ($C_5$-$C_{26}$), mixed alkanes, linear alcohols ($C_1$-$C_{20}$), branched-chain alcohols ($C_1$-$C_{26}$), linear carboxylic acids ($C_2$-$C_{20}$), and branched-chain carboxylic acids ($C_2$-$C_{26}$). In addition, ethers, esters and amides of the aforementioned acids and alcohols, as well as other conjugates of these chemicals may be of interest. Many of these chemicals can be subsequently converted by chemical reactions to other high value, high volume chemicals.

"Biomass" refers to organic matter. Biomass includes plant matter derived from herbaceous and woody energy crops, agricultural food and feed crops, agricultural crop wastes and residues, wood wastes and residues, aquatic plants, and other plant-derived materials. Biomass may also include algae, yard wastes, and include some municipal wastes. Biomass is a heterogeneous and chemically complex renewable resource. Components of biomass include glucan, xylan, fermentable sugars, arabinan, sucrose, lignin, protein, ash, extractives, ferulate, and acetate.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Conversion efficiency" refers to the conversion of biomass feedstock to free sugars, fermentable sugars, syngas, biofuel, ethanol, heat, or energy in a laboratory-, pilot-, or production-scale process. The relevant conversion efficiency parameters are dependent on the type of conversion process employed (biochemical, thermochemical to biofuel, or thermochemical to heat and electricity). NIR spectra of biomass samples are collected and translated by a NIR model (see below) to predict feedstock conversion properties (such as free sugars or accessible carbohydrate), one or more intermediate values that may serve for predicting feedstock conversion properties (such as recalcitrant carbohydrate), or one or more downstream parameters that are influenced by feedstock conversion efficiency (such as biofuel or energy yield). Predictions of conversion properties may be used to calculate the feedstock performance characteristics in one or more processing methods of interest. Such performance characteristics include saccharification efficiency or sugar yield (Glu, Xyl, Ara, Man, Gal), various enzymatic conditions (type, ratio, load) for saccharification, pretreatment conditions, total or net energy yield or energy conversion efficiency, biofuel yield or biofuel conversion efficiency, biopower yield or biopower conversion efficiency, coproduct yield or extraction/conversion efficiency, economic value of the original feedstock, NOX emissions, protein coproducts, or sustainability indicators.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Glucan," "Xylan" and "Arabinan" refer to the anhydro forms of glucose, xylose and arabinose that are found in cellulose and hemicellulose carbohydrate polymers. Thus, for example, "glucan" refers to a polysaccharide of D-glucose monomers linked by glycosidic bonds. The following are glucans: cellulose (β-1,4-glucan), dextran (α-1,6-glucan) and starch (α-1,4- and α-1,6-glucan).

"Hemicellulose" is a general term used to refer to cell wall polysaccharides that are not celluloses or pectins. Hemicelluloses contain repeating monomeric units of a five-carbon sugar (usually D-xylose or L-arabinose) and/or a six-carbon sugar (D-galactose, D-glucose, and D-mannose). See, U.S. Pat. No. 7,112,429. Hemicelluloses typically are shorter in length than cellulose and are highly branched. Xylan is often the structural backbone of hemicelluloses from hardwoods and grasses, and hydrolysis of these biomass types releases products high in the five-carbon sugar, xylose. Hemicelluloses from softwoods are most commonly gluco-galacto-mannans, which have a mannan backbone and yield mannose as the main product of hydrolysis. Hemicelluloses often contain side groups such as acetyl groups, uronic acids and ferulates.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Higher heating value" (HHV) refers to the amount of heat released by a specified quantity of a fuel at an initial temperature of 25° C., following combustion, and return of the combustion products to a temperature of 25° C. The HHV is also known as the gross calorific value or gross energy.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Lignin" refers to a polyphenolic polymeric substance of plant cells, with a complex, cross-linked, highly aromatic structure. Lignin is synthesized in plants principally from three monolignol monomers, which can be methoxylated to various degrees: sinapyl alcohol ($C_{11}H_{14}O_4$) that is incorporated into lignin as (S) syringyl units; coniferyl alcohol ($C_{10}H_{12}O_3$) that is incorporated into lignin as (G) guaiacyl units; and p-coumaryl alcohol ($C_9H_{10}O_2$) that is incorporated into lignin as (H) p-hydroxyphenyl units. These monomers can be synthesized into lignin by extensive condensation polymerization. The lignin present in different plant varieties can have different syringyl:guaiacyl:p-hydroxyphenyl weight percents (S:G:H weight percents). For example, certain grass varieties can have lignin composed almost entirely of guaiacyl (G). Lignin is a major structural constituent of plant cells in woody species.

"Modulation" of the level of biomass refers to the change in the level of the biomass that is observed as a result of expression of, or transcription from, an exogenous nucleic acid in a plant cell and/or plant. The change in level is measured relative to the corresponding level in control plants.

"NIR Model" refers to a series of validated mathematical equations that predict the chemical composition of a sample, based on NIR spectral data from the sample. The term also refers to a series of validated mathematical equations that predict saccharification conversion efficiency of a sample, based on NIR spectral data from the sample. In the case of saccharification conversion efficiency, a different NIR model is developed for each combination of pretreatment conditions and enzyme(s). NIR spectral data typically is obtained from the sample at a plurality of different wavelengths, and the mathematical equations are applied to the spectral data to calculate the predicted value. The calibration equations can be derived by regression among spectroscopic data for feedstock samples of the same type, e.g., by multiple-linear regression, by partial least squares, or by neural network analysis.

"NOX emissions" refers to mono-nitrogen oxides (NOx), such as NO and NO2, released into the atmosphere. While oxygen and nitrogen gases do not typically react at ambient temperatures, oxygen and nitrogen gases can react at higher temperatures to create various oxides of nitrogen, including mono-nitrogen oxides. Mono-nitrogen oxides can also be produced by combusting materials including elemental nitrogen. Mono-nitrogen oxides (NOx) released into the atmosphere can react with volatile organic compounds to produce smog. Accordingly, NOX emissions may be regulated by various governmental agencies. Oxides of sulfur (SOx), specifically sulfur dioxide, are often generated in the same processes. SOx emissions are known to contribute to acid rain.

"Nucleic acid" and "polynucleotide" are used interchangeably herein, and refer to both RNA and DNA, including cDNA, genomic DNA, synthetic DNA, and DNA or RNA containing nucleic acid analogs. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Recalcitrant carbohydrate material" refers to mono- and oligo-saccharides that are not released into the aqueous phase after processing of a biomass feedstock. It is related to the pretreatment and enzymatic saccharification conditions chosen for the saccharification process.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell,* 1:977-984 (1989).

"Saccharification" refers to the hydrolysis of carbohydrate material to the mono- and disaccharides that constitute the polymer. For example, saccharification of xylan results in the production of xylose, the monosaccharide constituent of xylan. Saccharification occurs during the biochemical processing of biomass in biorefineries, ultimately leading to the production of biofuels such as ethanol.

"Saccharification efficiency" of a feedstock sample refers to the total amount of mono and disaccharides solubilized by pretreatment/enzymatic saccharification processes, divided by the theoretical maximum amount of mono and disaccharides in the biomass sample that could have been released based on compositional analysis, converted to a percentage by multiplying by 100.

"Sustainability indicators" refer to components of biomass processing byproducts, such as the expected ash composition and soil nutrients, which may be recycled.

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. Polypeptides

Polypeptides described herein include biomass composition-modulating polypeptides. Biomass composition-modulating polypeptides can be effective to modulate biomass composition when expressed in a plant or plant cell. Such polypeptides typically contain at least one domain indicative of a biomass composition-modulating polypeptide, as described in more detail herein. Biomass composition-modulating polypeptides also typically have an HMM bit score that is greater than 65 as described in more detail herein. In some embodiments, biomass composition-modulating polypeptides have greater than 80% identity to SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823 as described in more detail herein.

A. Domains Indicative of Biomass Composition-Modulating Polypeptides

A biomass composition-modulating polypeptide can contain a methyltransferase_2 domain and a dimerization domain, which are predicted to be characteristic of a biomass composition-modulating polypeptide. SEQ ID NO:

562 sets forth the amino acid sequence of a *Panicum virgatum* clone, identified herein as CeresClone:1871180 (SEQ ID NO:561), that is predicted to encode a polypeptide containing a heavy-metal-associated domain. For example, a biomass composition-modulating polypeptide can comprise a heavy-metal-associated domain having 60 percent or greater (e.g., 65, 70, 75, 80, 85, 90, 95, 97, 98, 99, or 100 percent) sequence identity to residues 6 to 73 of SEQ ID NO: 562. In some embodiments, a biomass composition-modulating polypeptide can comprise a heavy-metal-associated domain having 60 percent or greater (e.g., 65, 70, 75, 80, 85, 90, 95, 97, 98, 99, or 100 percent) sequence identity to the heavy-metal-associated domain of one or more of the polypeptides set forth in SEQ ID NOs: 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, and 638. The heavy-metal-associated domains of such sequences are set forth in the Sequence Listing. The heavy-metal-associated domain is characteristic of proteins that transport heavy metals, and typically contains two conserved cysteines that may be involved in metal binding. See, e.g., Rosenzweig et al., *Structure Fold Des.*, 7:605-617 (1999).

A biomass composition-modulating polypeptide can contain a Myb-like DNA-binding domain, which is predicted to be characteristic of a biomass composition-modulating polypeptide. A polypeptide containing such a Myb-like DNA-binding domain can be useful, for example, for modulating sucrose content or conversion efficiency. SEQ ID NO: 246 sets forth the amino acid sequence of a *Zea mays* clone, identified herein as CeresClone:240112 (SEQ ID NO: 245) that is predicted to encode a polypeptide containing a Myb-like DNA-binding domain. For example, a biomass composition-modulating polypeptide can comprise a Myb-like DNA-binding domain having 60 percent or greater (e.g., 65, 70, 75, 80, 85, 90, 95, 97, 98, 99, or 100 percent) sequence identity to residues 212 to 263 of SEQ ID NO: 246. In some embodiments, a biomass composition-modulating polypeptide can comprise a Myb-like DNA-binding domain having 60 percent or greater (e.g., 65, 70, 75, 80, 85, 90, 95, 97, 98, 99, or 100 percent) sequence identity to the Myb-like DNA-binding domain of one or more of the polypeptides set forth in SEQ ID NOs: 248, 250, 251, 252, 254, 256, 258, 260, 261, 262, 264, 266, 268, 270, 272, 274, 275, 276, and 278. The Myb-like DNA-binding domains of such sequences are set forth in the Sequence Listing. The Myb_DNA-binding domain is found in the family of Myb proteins, as well as the SANT domain family. See, Aasland et al., *Trends Biochem Sci* 121:87-88 (1996). The SANT domain family specifically recognizes the sequence YAAC (G/T)G.

A biomass composition-modulating polypeptide can contain a DUF1070 domain, which is predicted to be characteristic of a biomass composition-modulating polypeptide. A polypeptide containing such a DUF1070 domain can be useful, for example, for modulating sucrose content. SEQ ID NO: 111 sets forth the amino acid sequence of a *Panicum virgatum* clone, identified herein as CeresClone:1764605 (SEQ ID NO:110) that is predicted to encode a polypeptide containing a DUF1070 domain. For example, a biomass composition-modulating polypeptide can comprise a DUF1070 domain having 60 percent or greater (e.g., 65, 70, 75, 80, 85, 90, 95, 97, 98, 99, or 100 percent) sequence identity to residues 4-52 of SEQ ID NO: 111. In some embodiments, a biomass composition-modulating polypeptide can comprise a DUF1070 domain having 60 percent or greater (e.g., 65, 70, 75, 80, 85, 90, 95, 97, 98, 99, or 100 percent) sequence identity to the DUF1070 domain of one or more of the polypeptides set forth in SEQ ID NOs: 113, 115, 117, 118, 120, 122, 124, 126, 128, 130, 132, 133, 135, 136, 138, 139, 141, 143, 145, 147, 148, 149, 151, 152, 153, 155. The DUF1070 domain is a conserved domain found in several short plant proteins, including the arabinogalactan peptide family. See, e.g., Schultz et al., *Plant Cell* 12:1751-68 (2000).

A biomass composition-modulating polypeptide can contain a glycosyl hydrolases family 16 domain and a xyloglucan endo-transglycosylase (XET) domain, which are predicted to be characteristic of a biomass composition-modulating polypeptide. A polypeptide containing such a glycosyl hydrolases family 16 domain and XET domain can be useful, for example, for modulating sucrose content or conversion efficiency. SEQ ID NO: 348 sets forth the amino acid sequence of a *Panicum virgatum* clone, identified herein as CeresClone:1776501 (SEQ ID NO: 347), that is predicted to encode a polypeptide containing a glycosyl hydrolases family 16 domain and a XET domain. For example, a biomass composition-modulating polypeptide can comprise a glycosyl hydrolases family 16 domain and a XET domain having 60 percent or greater (e.g., 65, 70, 75, 80, 85, 90, 95, 97, 98, 99, or 100 percent) sequence identity to residues 39 to 224 and 246 to 292 of SEQ ID NO: 348, respectively. In some embodiments, a biomass composition-modulating polypeptide can comprise a glycosyl hydrolases family 16 domain and a XET domain having 60 percent or greater (e.g., 65, 70, 75, 80, 85, 90, 95, 97, 98, 99, or 100 percent) sequence identity to the glycosyl hydrolases family 16 domain and XET domain of one or more of the polypeptides set forth in SEQ ID NOs: 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, and 414. The glycosyl hydrolases family 16 domain and XET domain of such sequences are set forth in the Sequence Listing. Proteins within the glycosyl hydrolase family 16 are O-glycosyl hydrolases that hydrolyze the glycosidic bond between two or more carbohydrates, or between a carbohydrate and a non-carbohydrate moiety. Members of the glycosyl hydrolase 16 family include lichenase, xyloglucan xyloglucosyltransferase, agarase, kappa-carrageenase, endo-beta-1,3-glucanase, endo-beta-1, 3-1,4-glucanase, and endo-beta-galactosidase. The XET domain is found in the C-terminus (approximately 60 residues) of plant xyloglucan endo-transglycosylases. Xyloglucan is the predominant hemicellulose in the cell walls of most dicotyledons. With cellulose, it forms a network that strengthens the cell wall. XET catalyzes the splitting of xyloglucan chains and the linking of the newly generated reducing end to the non-reducing end of another xyloglucan chain, thereby loosening the cell wall. See, for example, Schroder et al., *Planta*, 204:242-251 (1998).

A biomass composition-modulating polypeptide can contain an Alpha-L-AF_C domain and a CBM_4_9 domain, which are predicted to be characteristic of a biomass composition-modulating polypeptide. A polypeptide containing such an Alpha-L-AF_C domain and a CBM_4_9 domain can be useful, for example, for modulating sucrose content or conversion efficiency. SEQ ID NO: 774 sets forth the amino acid sequence of a *Panicum virgatum* clone, identified herein as CeresClone:1789981 (SEQ ID NO: 773), that is predicted to encode a polypeptide containing Alpha-L-AF_C and CBM_4_9 domains. For example, a biomass composition-modulating polypeptide can comprise an Alpha-L-AF_C domain having 60 percent or greater (e.g., 65, 70, 75, 80, 85, 90, 95, 97, 98, 99, or 100 percent) sequence identity to residues 454 to 643 of SEQ ID NO: 774 and a CBM_4_9 domain having 60 percent or greater (e.g., 65, 70, 75, 80, 85, 90, 95, 97, 98, 99, or 100 percent) sequence identity to residues 71 to 229 of SEQ ID NO: 774. In some embodiments, a biomass composition-modulating polypeptide can comprise Alpha-L-AF_C and CBM_4_9 domains having 60 percent or greater (e.g., 65, 70, 75, 80, 85, 90, 95, 97, 98, 99, or 100 percent) sequence identity to the Alpha-L-AF_C and CBM_4_9 domains of one or more of the polypeptides set forth in SEQ ID NOs: 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, and 821. The Alpha-L-AF_C and CBM_4_9 domains of such sequences are set forth in the Sequence Listing. The Alpha-L-AF_C domain represents the approximately 200 C-terminal residues of bacterial and eukaryotic alpha-L-arabinofuranosidase (EC:3.2.1.55), which catalyzes the hydrolysis of nonreducing terminal alpha-L-arabinofuranosidic linkages in L-arabinose-containing polysaccharides. The CBM_4_9 domain is a carbohydrate binding domain.

A biomass composition-modulating polypeptide can contain a COBRA domain, which is predicted to be characteristic of a biomass composition-modulating polypeptide. A polypeptide containing such a COBRA domain can be useful, for example, for modulating sucrose content or conversion efficiency. SEQ ID NO: 416 sets forth the amino acid sequence of a *Panicum virgatum* clone, identified herein as CeresClone:1804732 (SEQ ID NO: 415), that is predicted to encode a polypeptide containing a COBRA domain. For example, a biomass composition-modulating polypeptide can comprise a COBRA domain having 60 percent or greater (e.g., 65, 70, 75, 80, 85, 90, 95, 97, 98, 99, or 100 percent) sequence identity to residues 45 to 209 of SEQ ID NO: 416. In some embodiments, a biomass composition-modulating polypeptide can comprise a COBRA domain having 60 percent or greater (e.g., 65, 70, 75, 80, 85, 90, 95, 97, 98, 99, or 100 percent) sequence identity to the COBRA domain of one or more of the polypeptides set forth in SEQ ID NOs: 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, and 481. COBRA domains are found within a family of plant proteins designated COBRA-like (COBL) proteins. Members of the family are extracellular glycosyl-phosphatidyl inositol-anchored proteins (GPI-linked). COBRA is involved in determining the orientation of cell expansion, probably by playing an important role in cellulose deposition. It may act by recruiting cellulose synthesizing complexes to discrete positions on the cell surface. See Roudier et al., *Plant Cell.* 17(6):1749-63 (2005), Epub 2005 Apr. 22.

A biomass composition-modulating polypeptide can contain a glycosyl transferase family 8 domain, which is predicted to be characteristic of a biomass composition-modulating polypeptide. A polypeptide containing such a glycosyl transferase family 8 domain can be useful, for example, for modulating sucrose content. SEQ ID NO: 2 sets forth the amino acid sequence of a *Panicum virgatum* clone, identified herein as CeresClone:1807011 (SEQ ID NO: 1), that is predicted to encode a polypeptide containing a glycosyl transferase family 8 domain. For example, a biomass composition-modulating polypeptide can comprise a glycosyl transferase family 8 domain having 60 percent or greater (e.g., 65, 70, 75, 80, 85, 90, 95, 97, 98, 99, or 100 percent) sequence identity to residues 30 to 253 of SEQ ID NO: 2. In some embodiments, a biomass composition-modulating polypeptide can comprise a glycosyl transferase family 8 domain having 60 percent or greater (e.g., 65, 70, 75, 80, 85, 90, 95, 97, 98, 99, or 100 percent) sequence identity to the glycosyl transferase family 8 domain of one or more of the polypeptides set forth in SEQ ID NOs: 4, 6, 7, 8, 10, 12, 14, 15, 17, 18, 19, 20, 21, 22, and 24. The glycosyl transferase family 8 domains of such sequences are set forth in the Sequence Listing. The glycosyl transferase family 8 domain is found in a family of enzymes that transfer sugar residues to donor molecules. Members of this family include lipopolysaccharide galactosyltransferase, lipopolysaccharide glucosyltransferase 1, glycogenin glucosyltransferase, and inositol 1-alpha-galactosyltransferase. In some embodiments, a nucleic acid sequence encoding the amino acid sequence set forth in SEQ ID NO:2 or a homolog thereof can include a mutation (e.g., a deletion of a nucleotide) such that a truncated polypeptide is produced. For example, the nucleic acid sequence can include a mutation such that the amino acid sequence set forth in SEQ ID NO:2 is truncated at about position 142.

A biomass composition-modulating polypeptide can contain a DUF563 domain, which is predicted to be characteristic of a biomass composition-modulating polypeptide. A polypeptide containing such a DUF563 domain can be useful, for example, for modulating sucrose content. SEQ ID NO: 157 sets forth the amino acid sequence of a *Panicum virgatum* clone, identified herein as CeresClone:1888614 (SEQ ID NO: 156), that is predicted to encode a polypeptide containing a DUF563 domain. For example, a biomass composition-modulating polypeptide can comprise a DUF563 domain having 60 percent or greater (e.g., 65, 70, 75, 80, 85, 90, 95, 97, 98, 99, or 100 percent) sequence identity to residues 196 to 439 of SEQ ID NO: 157. In some embodiments, a biomass composition-modulating polypeptide can comprise a DUF563 domain having 60 percent or greater (e.g., 65, 70, 75, 80, 85, 90, 95, 97, 98, 99, or 100 percent) sequence identity to the DUF563 domain of one or more of the polypeptides set forth in SEQ ID NOs: 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, and 244. The DUF563 domains of such sequences are set forth in the Sequence Listing. Proteins having a DUF563 domain are in glycosyltransferase family 61.

A biomass composition-modulating polypeptide can contain a xyloglucan fucosyltransferase (XG_FTase) domain, which is predicted to be characteristic of a biomass composition-modulating polypeptide. A polypeptide containing such an XG_FTase domain can be useful, for example, for modulating sucrose content. SEQ ID NO: 280 sets forth the amino acid sequence of a *Panicum virgatum* clone, identified herein as CeresClone:1900192 (SEQ ID NO: 279), that is predicted to encode a polypeptide containing an XG_FTase domain. For example, a biomass composition-modulating polypeptide can comprise an XG_FTase domain having 60 percent or greater (e.g., 65, 70, 75, 80, 85, 90, 95, 97, 98, 99, or 100 percent) sequence identity to residues 72 to 574 of SEQ ID NO: 280. In some embodiments, a biomass composition-modulating polypeptide can comprise an XG_FTase domain having 60 percent or greater (e.g., 65, 70, 75, 80, 85, 90, 95, 97, 98, 99, or 100 percent) sequence identity to the XG_FTase domain of one or more of the polypeptides set forth in SEQ ID NOs: 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, and 346. The XG_FTase domains of such sequences are set forth in the Sequence Listing. The XG_FTase domain is found in a fucosyltransferase transfers the terminal fucosyl residue to xyloglucan (XG), the principal load-bearing hemicellulose of dicotyledonous plants. See, e.g., Perrin et al., *Science*, 284:1976-1979 (1999).

A biomass composition-modulating polypeptide can contain a glycosyl hydrolase family 16 domain and a xyloglucan endo-transglycosylase (XET) domain, which are predicted to be characteristic of a biomass composition-modulating polypeptide. A polypeptide containing such a glycosyl hydrolase family 16 domain and XET domain can be useful, for example, for modulating sucrose content or conversion efficiency. SEQ ID NO: 641 sets forth the amino acid sequence of a *Panicum virgatum* clone, identified herein as CeresClone:1955550 (SEQ ID NO: 640), that is predicted to encode a polypeptide containing a glycosyl hydrolase family 16 domain and a XET domain. For example, a biomass composition-modulating polypeptide can comprise a glycosyl hydrolases family 16 domain having 60 percent or greater (e.g., 65, 70, 75, 80, 85, 90, 95, 97, 98, 99, or 100 percent) sequence identity to residues 23 to 204 of SEQ ID NO: 641 and a XET domain having 60 percent or greater (e.g., 65, 70, 75, 80, 85, 90, 95, 97, 98, 99, or 100 percent) sequence identity to residues 228 to 280 of SEQ ID NO: 641. In some embodiments, a biomass composition-modulating polypeptide can comprise glycosyl hydrolases family 16 and XET domains having 60 percent or greater (e.g., 65, 70, 75, 80, 85, 90, 95, 97, 98, 99, or 100 percent) sequence identity to the glycosyl hydrolase family 16 and XET domains of one or more of the polypeptides set forth in SEQ ID NOs: 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, or 823. The glycosyl hydrolases family 16 and XET domains of such sequences are set forth in the Sequence Listing. The glycosyl hydrolases family 16 domain and XET domain are described above with reference to SEQ ID NO:348.

A biomass composition-modulating polypeptide can contain a potato inhibitor I family domain, which is predicted to be characteristic of a biomass composition-modulating polypeptide. A polypeptide containing such a potato inhibitor I family domain can be useful, for example, for modulating sucrose content. SEQ ID NO: 26 sets forth the amino acid sequence of a *Panicum virgatum* clone, identified herein as CeresClone:1955766 (SEQ ID NO: 25), that is predicted to encode a polypeptide containing a potato inhibitor I family domain. For example, a biomass composition-modulating polypeptide can comprise a potato inhibitor I family domain having 60 percent or greater (e.g., 65, 70, 75, 80, 85, 90, 95, 97, 98, 99, or 100 percent) sequence identity to residues 17 to 76 of SEQ ID NO: 26. In some embodiments, a biomass composition-modulating polypeptide can comprise a potato inhibitor I family domain having 60 percent or greater (e.g., 65, 70, 75, 80, 85, 90, 95, 97, 98, 99, or 100 percent) sequence identity to the potato inhibitor I family domain of one or more of the polypeptides set forth in SEQ ID NOs: 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, and 109. The potato inhibitor I family domains of such sequences are set forth in the Sequence Listing. Members of the potato inhibitor I family are proteinase inhibitors that inhibit peptidases of the S1 and S8 families. See, for example, Rawlings et al., *Biochem J.* 15, 378(Pt 3):705-16 (2004). Inhibitors in this family are small (60 to 90 residues) and lack disulfide bonds. Typically, the inhibitor is a wedge-shaped molecule, its pointed edge formed by the protease-binding loop, which contains the scissile bond. The loop binds tightly to the protease active site, with subsequent cleavage of the scissile bond causing inhibition of the enzyme. See, Bode et al., *EMBO J.*, 5(4):813-8 (1986).

In some embodiments, a biomass composition-modulating polypeptide is truncated at the amino- or carboxy-terminal end of a naturally occurring polypeptide. A truncated polypeptide may retain certain domains of the naturally occurring polypeptide while lacking others. Thus, length variants that are up to 5 amino acids shorter or longer typically exhibit the biomass composition-modulating activity of a truncated polypeptide. In some embodiments, a truncated polypeptide is a dominant negative polypeptide. Expression in a plant of such a truncated polypeptide confers a difference in biomass composition of a plant as compared to the corresponding level of a control plant that does not comprise the truncation.

B. Functional Homologs Identified by Reciprocal BLAST

In some embodiments, one or more functional homologs of a reference biomass composition-modulating polypeptide defined by one or more of the Pfam descriptions indicated above are suitable for use as biomass composition-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a biomass composition-modulating polypeptide, or by combining domains from the coding sequences for different naturally-occurring biomass composition-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of biomass composition-modulating polypeptides. Sequence analysis can involve BLAST, Reciprocal BLAST, or PSI-BLAST analysis of nonredundant databases using a biomass composition-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as a biomass composition-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in biomass composition-modulating polypeptides, e.g., conserved functional domains.

Conserved regions can be identified by locating a region within the primary amino acid sequence of a biomass composition-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al., *Nucl. Acids Res.,* 26:320-322 (1998); Sonnhammer et al., *Proteins,* 28:405-420 (1997); and Bateman et al., *Nucl. Acids Res.,* 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Examples of amino acid sequences of functional homologs of the polypeptide set forth in SEQ ID NO: 483 are provided in FIG. 1 and in the Sequence Listing. Such functional homologs include, for example, CeresAnnot: 8701398 (SEQ ID NO: 485), GI:21741986 (SEQ ID NO: 486), CeresClone:488555 (SEQ ID NO: 488), CeresAnnot: 1472210 (SEQ ID NO: 490), CeresClone:1839543 (SEQ ID NO: 492), GI:124360895 (SEQ ID NO: 493), CeresClone: 1778664 (SEQ ID NO: 495), CeresClone:2030878 (SEQ ID NO: 497), GI:115458882 (SEQ ID NO: 498), CeresAnnot: 8701404 (SEQ ID NO: 500), GI:115458830 (SEQ ID NO: 501), CeresAnnot:8701387 (SEQ ID NO: 503), GI:116310418 (SEQ ID NO: 504), CeresAnnot:8679943 (SEQ ID NO: 506), CeresAnnot:8701391 (SEQ ID NO: 508), GI:46806257 (SEQ ID NO: 509), GI:125540058 (SEQ ID NO: 510), CeresClone:1018979 (SEQ ID NO: 512), CeresClone:1725423 (SEQ ID NO: 514), GI:115446965 (SEQ ID NO: 515), GI:125540059 (SEQ ID NO: 516), GI:38606531 (SEQ ID NO: 517), CeresClone:1955791 (SEQ ID NO: 519), CeresClone:2032166 (SEQ ID NO: 521), GI:125540060 (SEQ ID NO: 522), GI:46806261 (SEQ ID NO: 523), CeresClone:100178733 (SEQ ID NO: 525), CeresClone:351547 (SEQ ID NO: 527), CeresClone: 1906874 (SEQ ID NO: 529), CeresClone:273420 (SEQ ID NO: 531), CeresAnnot:8701399 (SEQ ID NO: 533), GI:125540061 (SEQ ID NO: 534), GI:115446971 (SEQ ID NO: 535), CeresClone:1802499 (SEQ ID NO: 537), Ceres-Clone:1850157 (SEQ ID NO: 539), CeresClone:1471240 (SEQ ID NO: 541), CeresAnnot:8679942 (SEQ ID NO: 543), CeresClone:1024049 (SEQ ID NO: 545), CeresAnnot: 885518 (SEQ ID NO: 547), CeresAnnot:871243 (SEQ ID NO: 549), CeresAnnot:1461629 (SEQ ID NO: 551), GI:27754556 (SEQ ID NO: 552), CeresAnnot:8679941 (SEQ ID NO: 554), CeresClone:1846767 (SEQ ID NO: 556), GI: 118489467 (SEQ ID NO: 557), and CeresAnnot: 1480319 (SEQ ID NO: 559). In some cases, a functional homolog of SEQ ID NO: 483 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 483. In some cases, a functional homolog of SEQ ID NO: 483 has an amino acid sequence with at least 45% sequence identity, e.g., 50%, 52%, 56%, 59%, 6%, 65%, 70%, 75%, 80%, 85%, 90%, 95%, 97%, 98%, or 99% sequence identity, to one or more functional homologs of SEQ ID NO: 483 described above or set forth in the Sequence Listing.

Figure 2B:
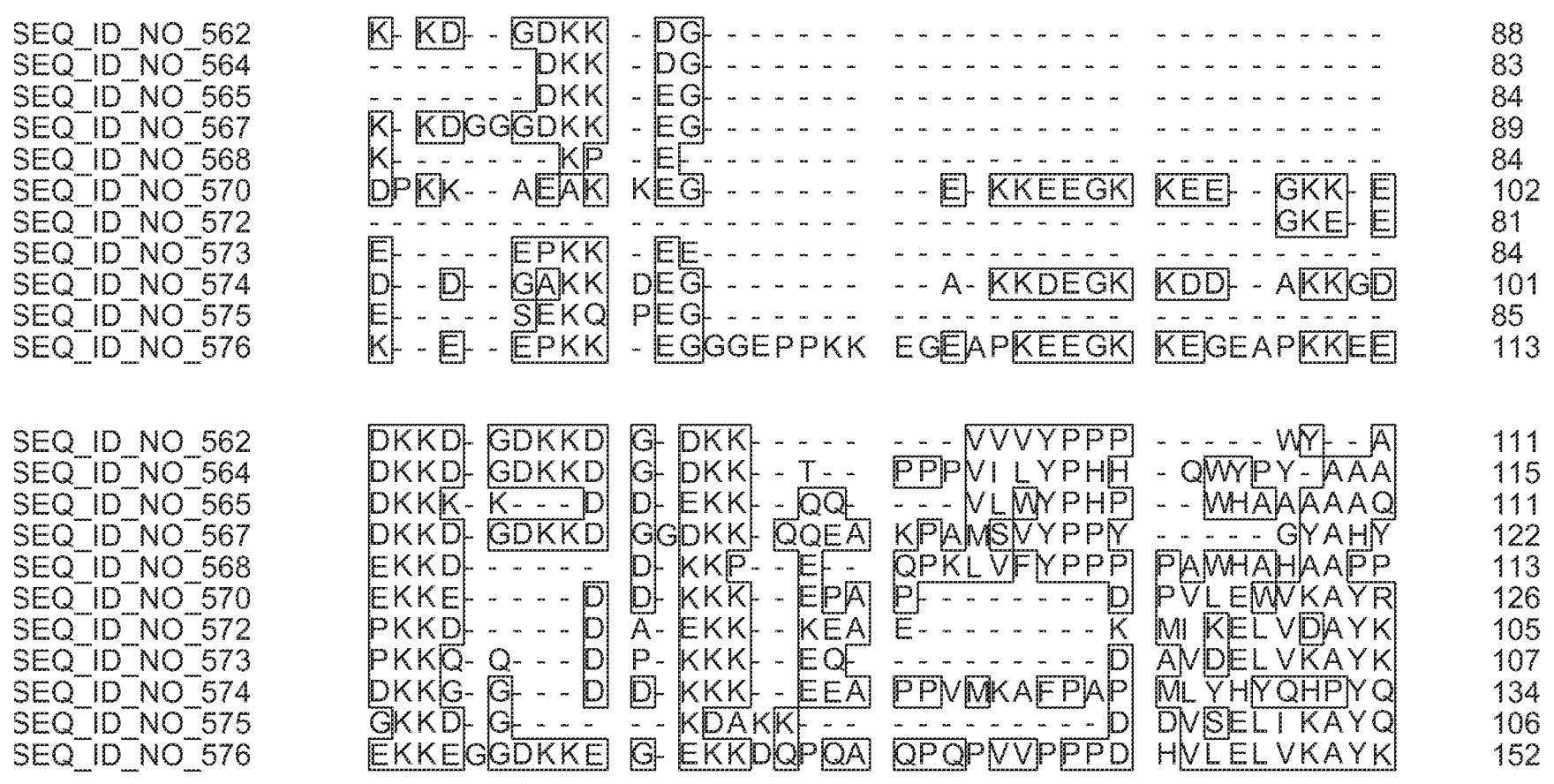

Examples of amino acid sequences of functional homologs of the polypeptide set forth in SEQ ID NO: 562 are provided in FIG. 2 and in the Sequence Listing. Such functional homologs include, for example, CeresAnnot: 8703443 (SEQ ID NO: 564), GI: 194702514 (SEQ ID NO: 565), CeresClone:699934 (SEQ ID NO: 567), GI:32488374 (SEQ ID NO: 568), CeresClone:1642517 (SEQ ID NO: 570), CeresClone:1799746 (SEQ ID NO: 572), GI:224077486 (SEQ ID NO: 573), GI:83283997 (SEQ ID NO: 574), GI:171451994 (SEQ ID NO: 575), GI:15223416 (SEQ ID NO: 576), CeresClone:1999925 (SEQ ID NO: 578), CeresClone:100177220 (SEQ ID NO: 580), Ceres-Clone:1822001 (SEQ ID NO: 582), CeresClone:570418 (SEQ ID NO: 584), CeresClone:1998324 (SEQ ID NO: 586), CeresClone:706252 (SEQ ID NO: 588), GI:77554837 (SEQ ID NO: 589), GI:125536425 (SEQ ID NO: 590), CeresAnnot:1447508 (SEQ ID NO: 592), CeresClone: 1965618 (SEQ ID NO: 594), CeresClone:1626139 (SEQ ID NO: 596), CeresAnnot:8640237 (SEQ ID NO: 598), GI:115450453 (SEQ ID NO: 599), CeresAnnot:1438634 (SEQ ID NO: 601), GI:147787209 (SEQ ID NO: 602), GI:115483110 (SEQ ID NO: 603), CeresClone:263964 (SEQ ID NO: 605), CeresAnnot:1449592 (SEQ ID NO: 607), GI:115461178 (SEQ ID NO: 608), GI:29124977 (SEQ ID NO: 609), CeresClone:476087 (SEQ ID NO: 611), CeresClone:1587840 (SEQ ID NO: 613), CeresClone: 1808797 (SEQ ID NO: 615), CeresClone:538771 (SEQ ID NO: 617), CeresClone:1851138 (SEQ ID NO: 619), Ceres-Clone:1049645 (SEQ ID NO: 621), GI:92897781 (SEQ ID NO: 622), CeresAnnot:1487378 (SEQ ID NO: 624), GI:92897782 (SEQ ID NO: 625), CeresClone:648917 (SEQ ID NO: 627), CeresClone:100011205 (SEQ ID NO: 629), GI:116783342 (SEQ ID NO: 630), CeresAnnot:1449591 (SEQ ID NO: 632), CeresClone:521942 (SEQ ID NO: 634), CeresClone:1653508 (SEQ ID NO: 636), and CeresAnnot: 1487377 (SEQ ID NO: 638). In some cases, a functional homolog of SEQ ID NO: 562 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 562. In some cases, a functional homolog of SEQ ID NO: 562 has an amino acid sequence with at least 45% sequence identity, e.g., 50%, 52%, 56%, 59%, 61%, 65%, 70%, 75%, 80%, 8%, 90%, 95%, 97%, 98%, or 99% sequence identity, to one or more functional homologs of SEQ ID NO: 562 described above or set forth in the Sequence Listing.

Figure 3B:
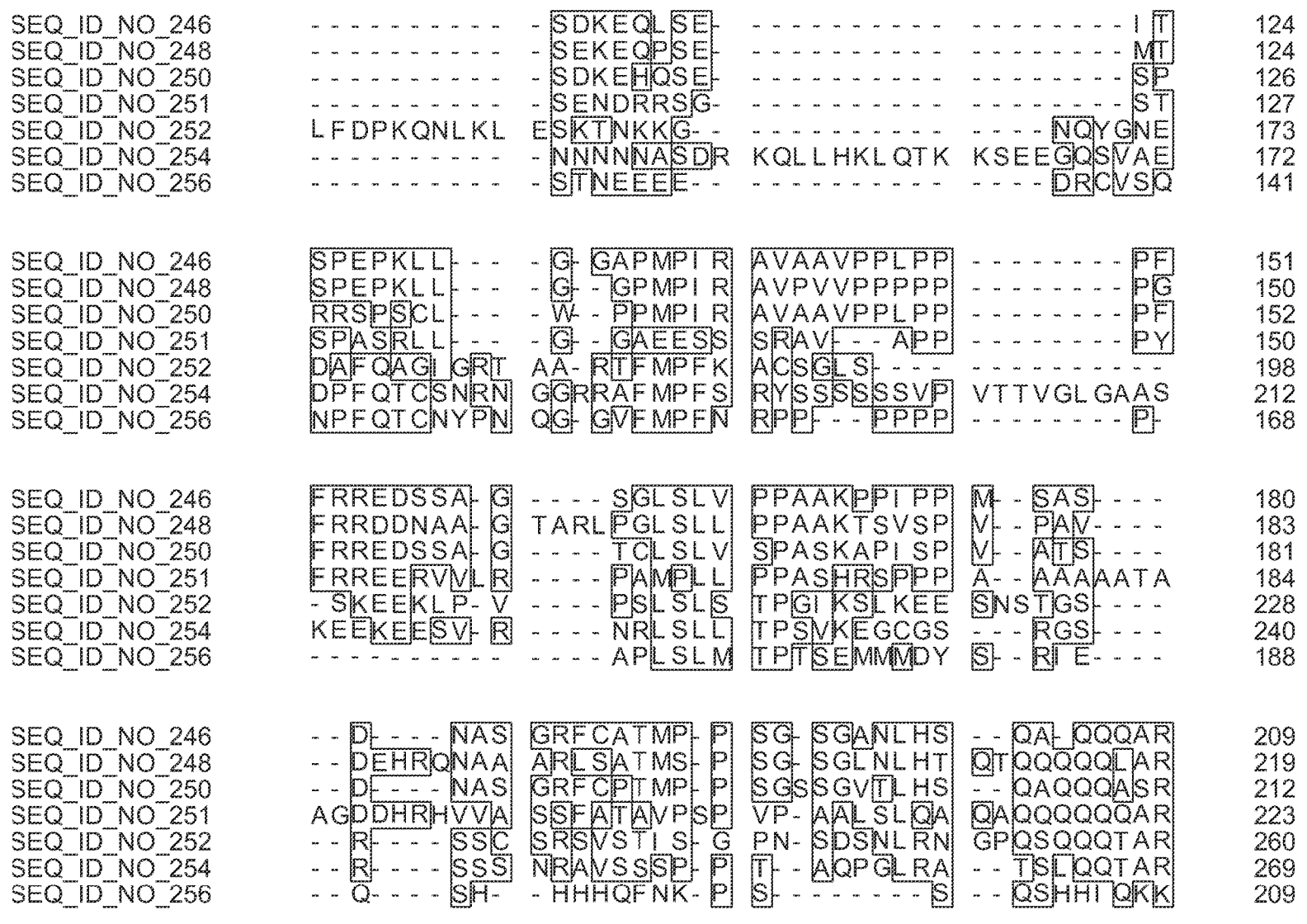

Examples of amino acid sequences of functional homologs of the polypeptide set forth in SEQ ID NO: 246 are provided in FIG. 3 and in the Sequence Listing. Such functional homologs include, for example, CeresClone: 1791988 (SEQ ID NO: 248), CeresAnnot:8632546 (SEQ ID NO: 250), GI:115455537 (SEQ ID NO: 251), GI:118486821 (SEQ ID NO: 252), CeresClone:537690 (SEQ ID NO: 254), CeresAnnot:880540 (SEQ ID NO: 256), CeresClone:797459 (SEQ ID NO: 258), CeresClone:630408 (SEQ ID NO: 260), GI:125557053 (SEQ ID NO: 261), GI:125588020 (SEQ ID NO: 262), CeresAnnot:1733246 (SEQ ID NO: 264), CeresAnnot:1451294 (SEQ ID NO: 266), CeresAnnot:1457031 (SEQ ID NO: 268), CeresClone:100063507 (SEQ ID NO: 270), CeresClone:560820 (SEQ ID NO: 272), CeresClone:1104471 (SEQ ID NO: 274), GI:30690890 (SEQ ID NO: 275), GI:18402692 (SEQ ID NO: 276), and CeresClone:2686 (SEQ ID NO: 278). In some cases, a functional homolog of SEQ ID NO: 246 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 246. In some cases, a functional homolog of SEQ ID NO: 246 has an amino acid sequence with at least 45% sequence identity, e.g., 50%, 52%, $5^6$%, 59%, 61%, 65%, 70%, 75%, 80%, 85%, 90%, 95%, 97%, 98%, or 99% sequence identity, to one or more functional homologs of SEQ ID NO: 246 described above or set forth in the Sequence Listing.

Examples of amino acid sequences of functional homologs of the polypeptide set forth in SEQ ID NO: 111 are provided in FIG. 4 and in the Sequence Listing. Such functional homologs include, for example, CeresAnnot:8726250 (SEQ ID NO: 113), CeresClone:899059 (SEQ ID NO:115), CeresClone:945132 (SEQ ID NO:117), GI:115462673 (SEQ ID NO:118), CeresClone:16400 (SEQ ID NO:120), CeresClone:1712201 (SEQ ID NO:122), CeresAnnot:1524669 (SEQ ID NO:124), CeresAnnot:8672987 (SEQ ID NO:126), CeresClone:1434951 (SEQ ID NO:128), CeresClone:299745 (SEQ ID NO:130), CeresClone:323696 (SEQ ID NO:132), GI:194695666 (SEQ ID NO:133), CeresClone:1771257 (SEQ ID NO:135), GI:115445433 (SEQ ID NO:136), CeresAnnot:8667876 (SEQ ID NO:138), GI:115438957 (SEQ ID NO:139), CeresClone:1100814 (SEQ ID NO:141), CeresClone:1029710 (SEQ ID NO:143), CeresClone:969326 (SEQ ID NO:145), CeresClone:100955392 (SEQ ID NO:147), GI:225454450 (SEQ ID NO:148), GI:116779724 (SEQ ID NO:149), CeresAnnot:1447561 (SEQ ID NO:151), GI:20149060 (SEQ ID NO:152), GI:225462683 (SEQ ID NO:153), and CeresClone:595099 (SEQ ID NO:155). In some cases, a functional homolog of SEQ ID NO: 111 has an amino acid sequence with at least 45% sequence identity, e.g., 50%, 52%, 56%, 59%, 61%, 6%, 0%, 7%, 80%, 85%, 90%, 95%, 97%, 98%, or 99% sequence identity, to the amino acid sequence set forth in SEQ ID NO: 111. In some cases, a functional homolog of SEQ ID NO: 111 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 111 described above or set forth in the Sequence Listing.

Figure 5A:
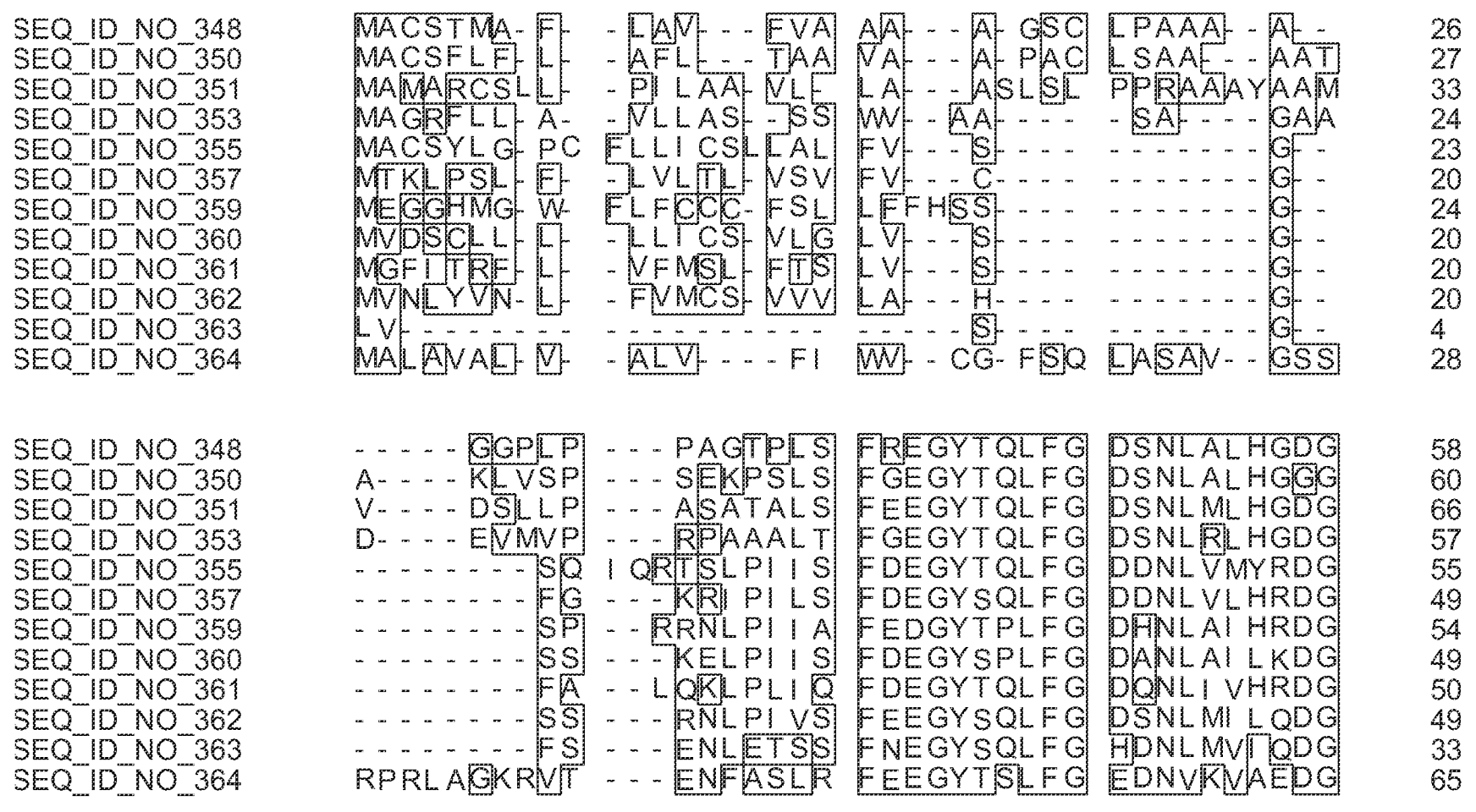

Examples of amino acid sequences of functional homologs of the polypeptide set forth in SEQ ID NO: 348 are provided in FIG. 5 and in the Sequence Listing. Such functional homologs include, for example, CeresAnnot:8642214 (SEQ ID NO: 350), GI:115451805 (SEQ ID NO: 351), CeresClone:890595 (SEQ ID NO: 353), CeresAnnot:1463701 (SEQ ID NO: 355), CeresClone:1840970 (SEQ ID NO: 357), CeresClone:672495 (SEQ ID NO: 359), GI:225424452 (SEQ ID NO: 360), GI:15223878 (SEQ ID NO: 361), GI:13560781 (SEQ ID NO: 362), GI:6681351 (SEQ ID NO: 363), GI:116786783 (SEQ ID NO: 364), GI:125543052 (SEQ ID NO: 365), GI: 124109193 (SEQ ID NO: 366), CeresAnnot:8653921 (SEQ ID NO: 368), CeresClone:1995976 (SEQ ID NO: 370), CeresClone:369312 (SEQ ID NO: 372), GI:17047034 (SEQ ID NO: 373), GI:118482018 (SEQ ID NO: 374), GI:125530964 (SEQ ID NO: 375), GI:125563629 (SEQ ID NO: 376), GI:147797772 (SEQ ID NO: 377), CeresClone:18876 (SEQ ID NO: 379), GI:125540767 (SEQ ID NO: 380), GI:115448069 (SEQ ID NO: 381), CeresClone:683310 (SEQ ID NO: 383), GI:125605601 (SEQ ID NO: 384), CeresClone:1922671 (SEQ ID NO: 386), CeresClone:100961902 (SEQ ID NO: 388), CeresAnnot:1447077 (SEQ ID NO: 390), CeresClone:1643790 (SEQ ID NO: 392), GI:125580663 (SEQ ID NO: 393), GI:116785331 (SEQ ID NO: 394), CeresAnnot:1485570 (SEQ ID NO: 396), CeresAnnot:8681188 (SEQ ID NO: 398), CeresClone:1818189 (SEQ ID NO: 400), CeresClone:100861631 (SEQ ID NO: 402), CeresAnnot:8671232 (SEQ ID NO: 404), CeresClone:1813525 (SEQ ID NO: 406), GI:15222593 (SEQ ID NO: 407), GI:42795460 (SEQ ID NO: 408), CeresClone:1828819 (SEQ ID NO: 410), CeresAnnot:1460297 (SEQ ID NO: 412), GI:225424689 (SEQ ID NO: 413), and GI:76786474 (SEQ ID NO: 414). In some cases, a functional homolog of SEQ ID NO: 348 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 348. In some cases, a functional homolog of SEQ ID NO: 348 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 348 described above or set forth in the Sequence Listing.

Figure 6C:
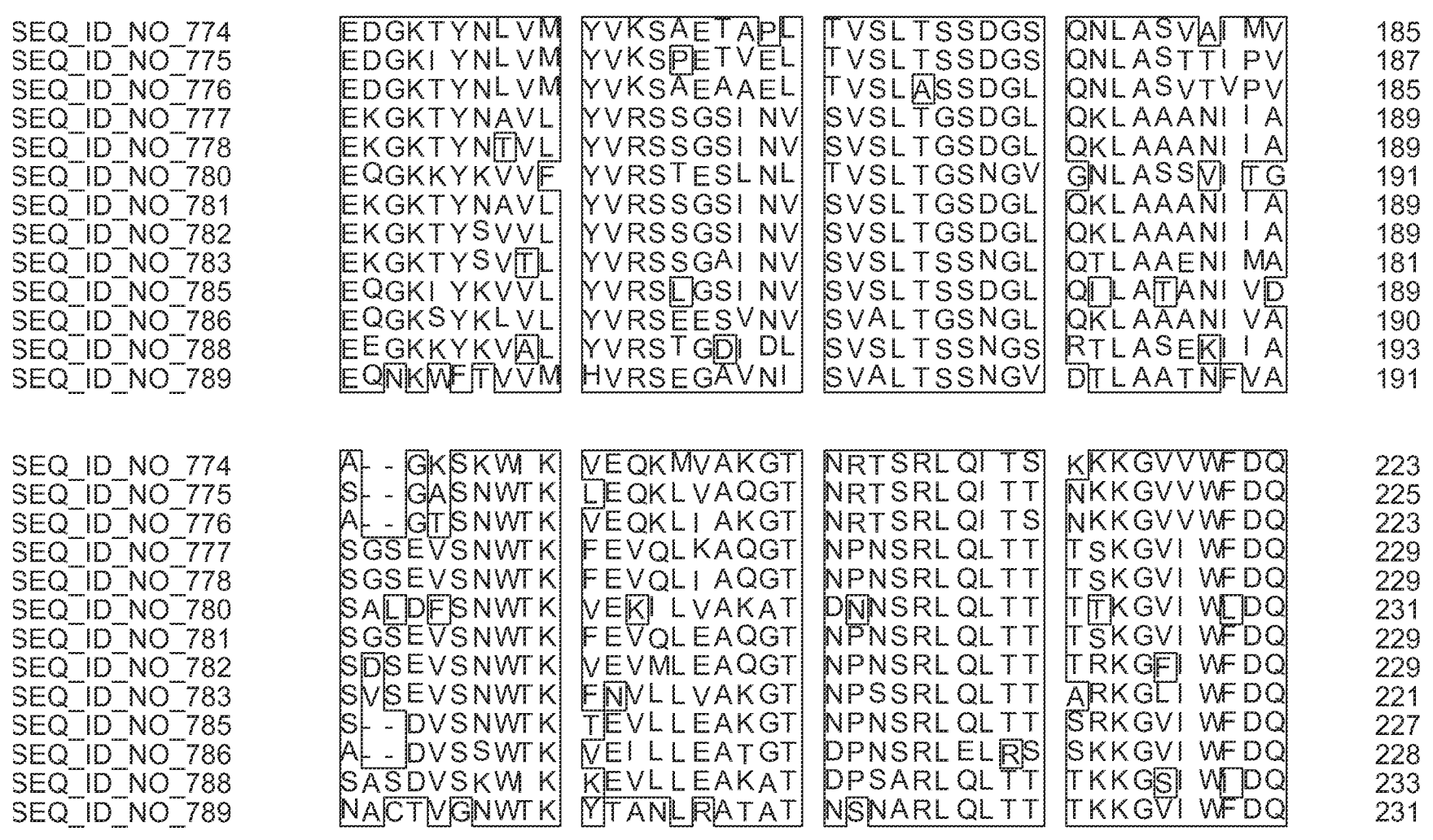
Figure 6E:
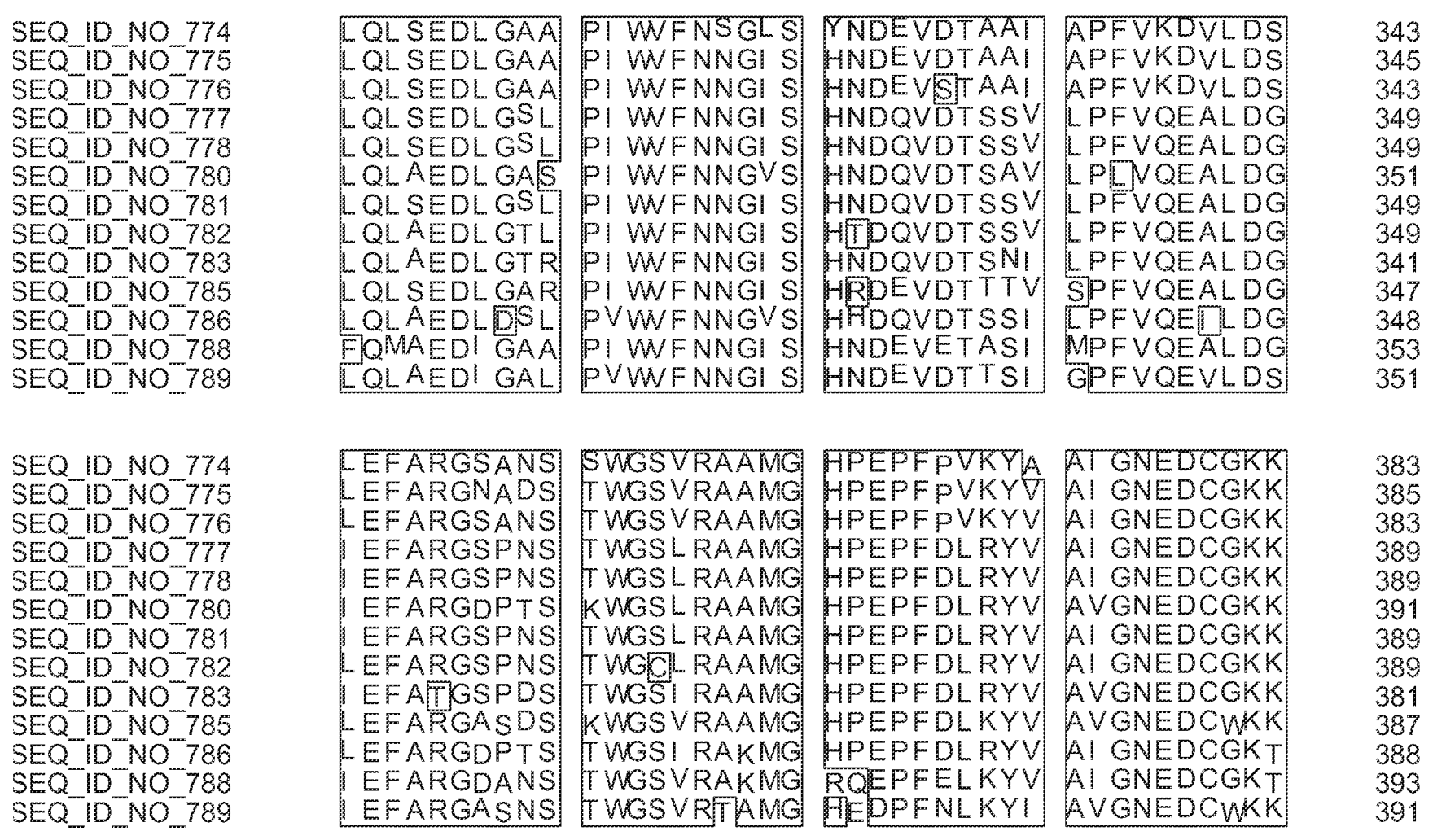
Figure 6H:
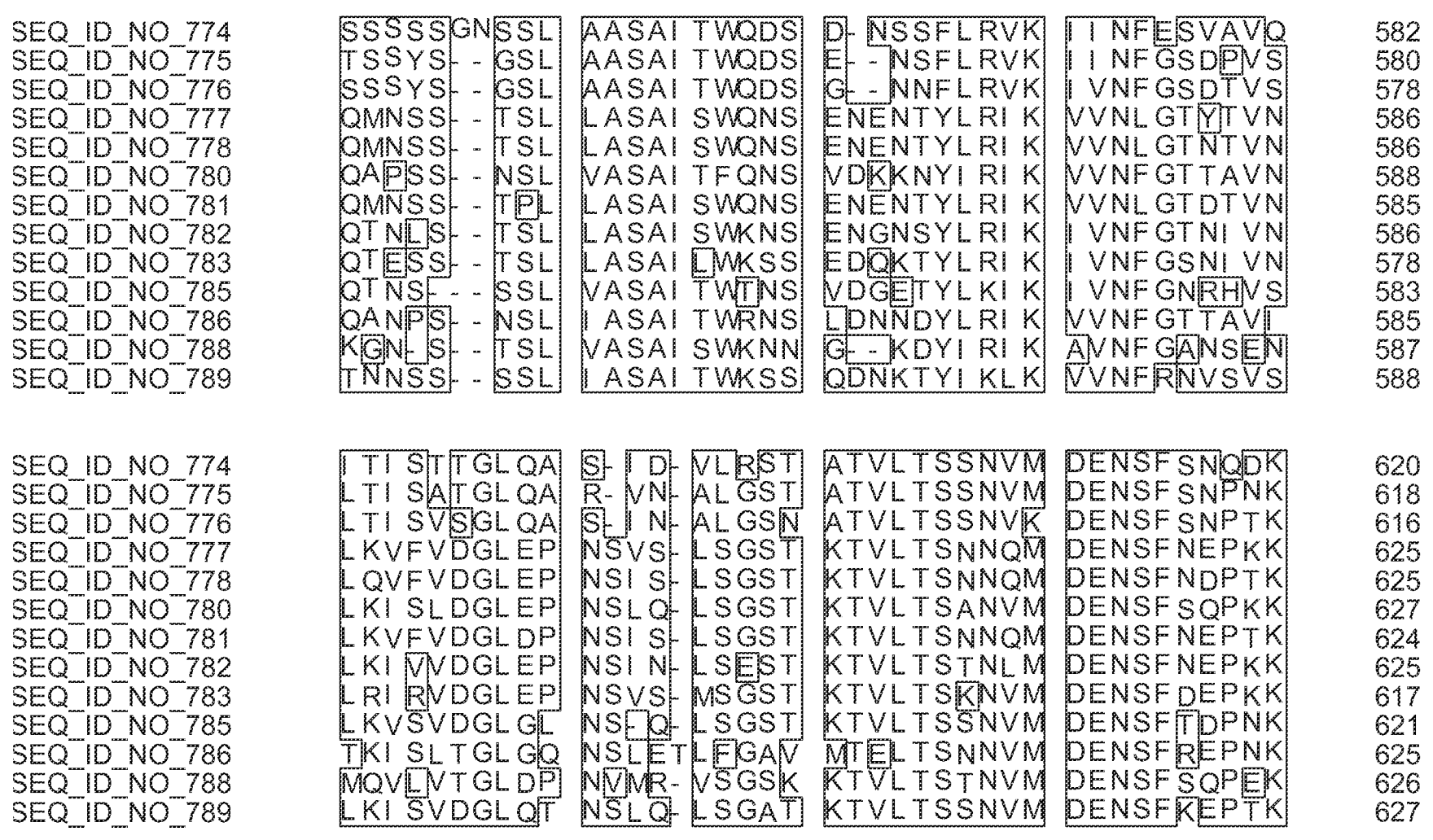

Examples of amino acid sequences of functional homologs of the polypeptide set forth in SEQ ID NO: 774 are provided in FIG. 6 and in the Sequence Listing. Such functional homologs include, for example, GI:115483997 (SEQ ID NO: 775), GI:13398414 (SEQ ID NO: 776), GI:33151175 (SEQ ID NO: 777), GI:119507455 (SEQ ID NO: 778), CeresClone:549408 (SEQ ID NO: 780), GI:37777015 (SEQ ID NO: 781), GI:157313302 (SEQ ID NO: 782), GI:157072586 (SEQ ID NO: 783), CeresAnnot:1506572 (SEQ ID NO: 785), GI:16417958 (SEQ ID NO: 786), CeresAnnot:556941 (SEQ ID NO: 788), GI:225440254 (SEQ ID NO: 789), CeresClone:1753603 (SEQ ID NO: 791), CeresClone:236733 (SEQ ID NO: 793), CeresClone:1786359 (SEQ ID NO: 795), GI:115487150 (SEQ ID NO: 796), CeresAnnot:8682811 (SEQ ID NO: 798), GI:13398412 (SEQ ID NO: 799), GI:116310992 (SEQ ID NO: 800), GI:38347003 (SEQ ID NO: 801), GI:116739148 (SEQ ID NO: 802), GI:22324432 (SEQ ID NO: 803), CeresAnnot:1453426 (SEQ ID NO: 805), CeresAnnot:8657414 (SEQ ID NO: 807), GI: 108707861 (SEQ ID NO: 808), CeresAnnot:1528070 (SEQ ID NO: 810), GI:22327075 (SEQ ID NO: 811), GI:50507838 (SEQ ID NO: 812), GI:168060089 (SEQ ID NO: 813), GI:160890886 (SEQ ID NO: 814), GI:189464007 (SEQ ID NO: 815), GI:154492683 (SEQ ID NO: 816), GI:146300858 (SEQ ID NO: 817), GI:150008552 (SEQ ID NO: 818), GI:86142284 (SEQ ID NO: 819), GI:148269769 (SEQ ID NO: 820), and GI:170288456 (SEQ ID NO: 821). In some cases, a functional homolog of SEQ ID NO: 774 has an amino acid sequence with at least 45% sequence identity, e.g., 50%, $5^2$%, 56%, 59%, 61%, 65%, 70%, 75%, 80%, 85%, 90%, 95%, 97%, 98%, or 99% sequence identity, to the amino acid sequence set forth in SEQ ID NO: 774. In some cases, a functional homolog of SEQ ID NO: 774 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 774 described above or set forth in the Sequence Listing.

Figure 7A:
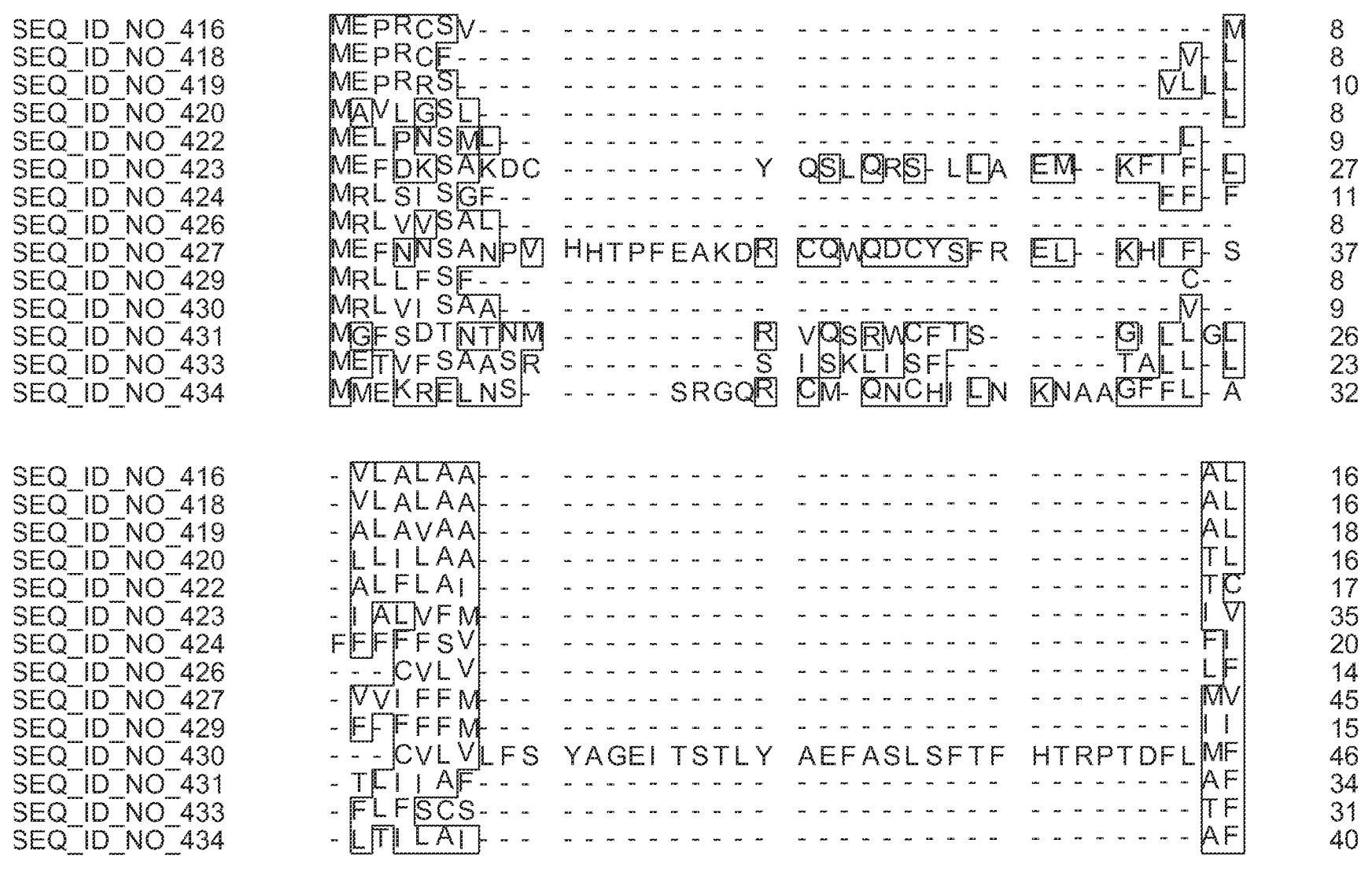
Figure 7G:
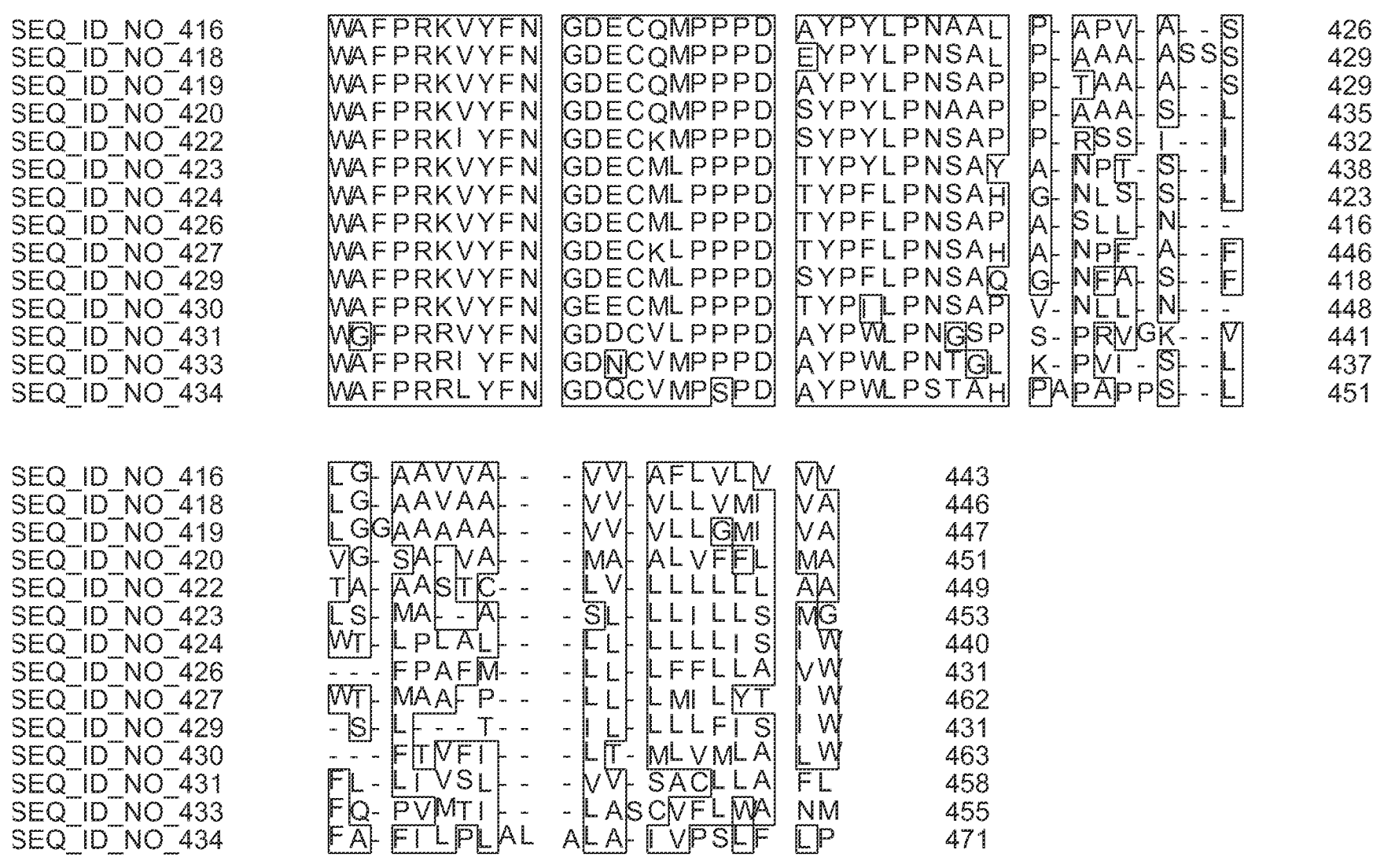

Examples of amino acid sequences of functional homologs of the polypeptide set forth in SEQ ID NO: 416 are provided in FIG. 7 and in the Sequence Listing. Such functional homologs include, for example, CeresAnnot: 8656625 (SEQ ID NO: 418), GI:162462515 (SEQ ID NO: 419), GI:75133694 (SEQ ID NO: 420), CeresClone:829440 (SEQ ID NO: 422), GI:118488472 (SEQ ID NO: 423), GI:90657534 (SEQ ID NO: 424), CeresClone:1237946 (SEQ ID NO: 426), GI:225456557 (SEQ ID NO: 427), CeresAnnot:1355066 (SEQ ID NO: 429), GI:38194917 (SEQ ID NO: 430), GI:116788824 (SEQ ID NO: 431), CeresClone:1848658 (SEQ ID NO: 433), GI:116790012 (SEQ ID NO: 434), CeresClone:570485 (SEQ ID NO: 436), GI:125559102 (SEQ ID NO: 437), CeresClone:1957107 (SEQ ID NO: 439), CeresClone:1781794 (SEQ ID NO: 441), GI:115453531 (SEQ ID NO: 442), CeresClone: 285169 (SEQ ID NO: 444), CeresAnnot:1450186 (SEQ ID NO: 446), CeresClone:1806851 (SEQ ID NO: 448), GI:38194916 (SEQ ID NO: 449), GI:225451792 (SEQ ID NO: 450), GI:225456559 (SEQ ID NO: 451), GI:224124236 (SEQ ID NO: 452), CeresClone:17250 (SEQ ID NO: 454), CeresAnnot:1363625 (SEQ ID NO: 456), CeresAnnot: 1450185 (SEQ ID NO: 458), GI:125552171 (SEQ ID NO: 459), GI:115463639 (SEQ ID NO: 460), CeresAnnot: 1809854 (SEQ ID NO: 462), GI:162462330 (SEQ ID NO: 463), CeresAnnot:1326475 (SEQ ID NO: 465), GI:125559101 (SEQ ID NO: 466), CeresAnnot:8632643 (SEQ ID NO: 468), CeresClone:1546455 (SEQ ID NO: 470), CeresClone:1788775 (SEQ ID NO: 472), GI:162462156 (SEQ ID NO: 473), GI:125545759 (SEQ ID NO: 474), CeresClone:236876 (SEQ ID NO: 476), CeresAnnot:8640602 (SEQ ID NO: 478), GI:30090032 (SEQ ID NO: 479), GI:38230578 (SEQ ID NO: 480), and GI:115453533 (SEQ ID NO: 481). In some cases, a functional homolog of SEQ ID NO: 416 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 416. In some cases, a functional homolog of SEQ ID NO: 416 has an amino acid sequence with at least 45% sequence identity, e.g., 50%, 52%, 56%, 59%, 6%, 65%, 70%, 75%, 80%, 85%, 90%, 95%, 97%, 98%, or 99% sequence identity, to one or more functional homologs of SEQ ID NO: 416 described above or set forth in the Sequence Listing.

Examples of amino acid sequences of functional homologs of the polypeptide set forth in SEQ ID NO: 2 are provided in FIG. 8 and in the Sequence Listing. Such functional homologs include, for example, CeresAnnot: 8701928 (SEQ ID NO: 4), CeresClone:630287 (SEQ ID NO: 6), GI:115447391 (SEQ ID NO: 7), GI:225453032 (SEQ ID NO: 8), CeresClone:1919301 (SEQ ID NO: 10), CeresAnnot:883070 (SEQ ID NO: 12), CeresAnnot: 1469624 (SEQ ID NO: 14), GI:168065791 (SEQ ID NO: 15), CeresClone:1887777 (SEQ ID NO: 17), GI:57834149 (SEQ ID NO: 18), GI:116310214 (SEQ ID NO: 19), GI:18087513 (SEQ ID NO: 20), GI:147841543 (SEQ ID NO: 21), GI:168014382 (SEQ ID NO: 22), and CeresAnnot: 8462062 (SEQ ID NO: 24). In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2 described above or set forth in the Sequence Listing.

Figure 9F:
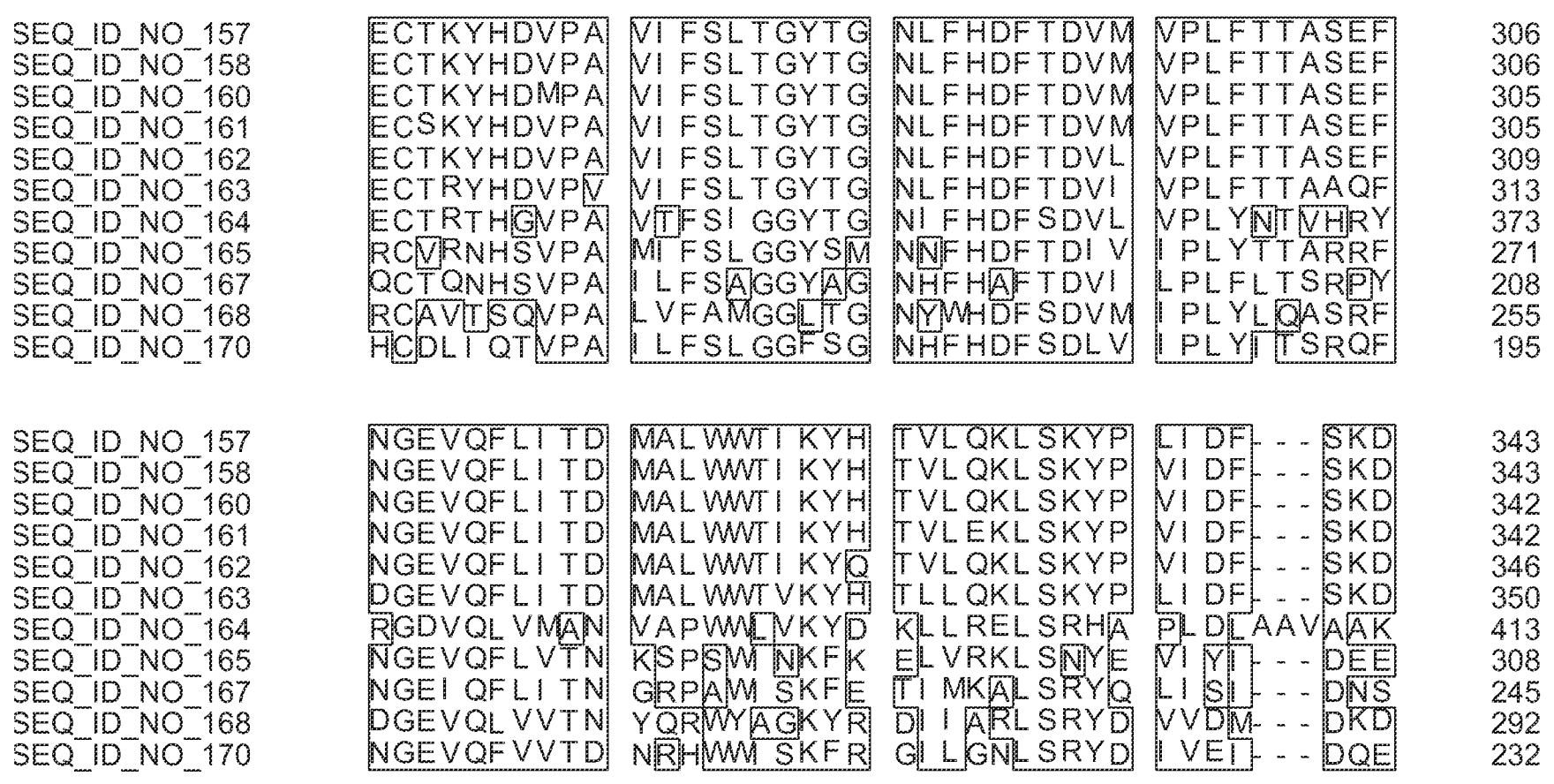
Figure 9H:
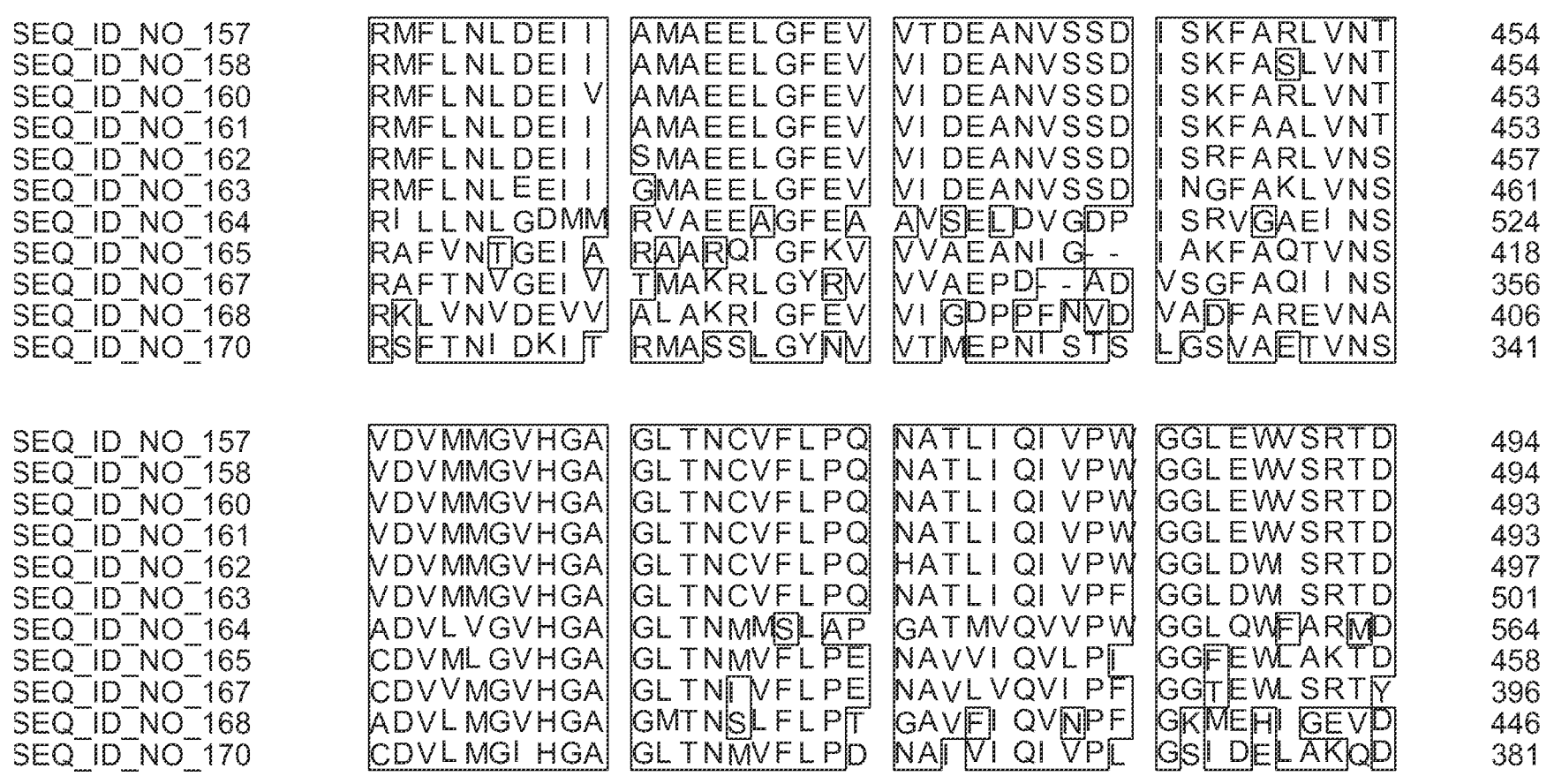

Examples of amino acid sequences of functional homologs of the polypeptide set forth in SEQ ID NO: 157 are provided in FIG. 9 and in the Sequence Listing. Such functional homologs include, for example, GI:56409850 (SEQ ID NO: 158), CeresAnnot:8740887 (SEQ ID NO: 160), GI:162460428 (SEQ ID NO: 161), GI:115453815 (SEQ ID NO: 162), GI:56409844 (SEQ ID NO: 163), GI:31339690 (SEQ ID NO: 164), GI:9294073 (SEQ ID NO: 165), CeresAnnot:1473325 (SEQ ID NO: 167), GI:31296713 (SEQ ID NO: 168), CeresClone:1925376 (SEQ ID NO: 170), GI:56409848 (SEQ ID NO: 171), GI:125544555 (SEQ ID NO: 172), GI:115445881 (SEQ ID NO: 173), CeresAnnot:8674833 (SEQ ID NO: 175), CeresClone:914572 (SEQ ID NO: 177), CeresAnnot:8659084 (SEQ ID NO: 179), CeresClone:1781320 (SEQ ID NO: 181), GI:53791307 (SEQ ID NO: 182), CeresAnnot: 8659080 (SEQ ID NO: 184), GI:212275650 (SEQ ID NO: 185), CeresClone:1818693 (SEQ ID NO: 187), CeresClone: 508386 (SEQ ID NO: 189), GI:53791309 (SEQ ID NO: 190), CeresAnnot:8659051 (SEQ ID NO: 192), CeresClone: 1862153 (SEQ ID NO: 194), CeresClone:1902844 (SEQ ID NO: 196), GI:212275101 (SEQ ID NO: 197), CeresClone: 1844210 (SEQ ID NO: 199), CeresAnnot:8658929 (SEQ ID NO: 201), GI:125555301 (SEQ ID NO: 202), CeresClone: 825530 (SEQ ID NO: 204), GI:115444075 (SEQ ID NO: 205), CeresClone:1748522 (SEQ ID NO: 207), GI:115445889 (SEQ ID NO: 208), CeresAnnot:8671335 (SEQ ID NO: 210), GI:53791308 (SEQ ID NO: 211), CeresClone:1899806 (SEQ ID NO: 213), CeresClone: 1726616 (SEQ ID NO: 215), GI:162460449 (SEQ ID NO: 216), CeresClone:1770027 (SEQ ID NO: 218), CeresAnnot: 1467806 (SEQ ID NO: 220), GI:55792425 (SEQ ID NO: 221), GI:56409862 (SEQ ID NO: 222), GI: 115482674 (SEQ ID NO: 223), CeresClone:815962 (SEQ ID NO: 225), GI:56409860 (SEQ ID NO: 226), CeresAnnot:8670072 (SEQ ID NO: 228), CeresAnnot:1473327 (SEQ ID NO: 230), CeresClone:1726182 (SEQ ID NO: 232), CeresAnnot: 8734902 (SEQ ID NO: 234), CeresAnnot:8741882 (SEQ ID NO: 236), CeresClone:761431 (SEQ ID NO: 238), CeresAnnot:8678791 (SEQ ID NO: 240), CeresClone:845464 (SEQ ID NO: 242), and CeresClone:1726076 (SEQ ID NO: 244). In some cases, a functional homolog of SEQ ID NO: 157 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 157. In some cases, a functional homolog of SEQ ID NO: 157 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 157 described above or set forth in the Sequence Listing.

Examples of amino acid sequences of functional homologs of the polypeptide set forth in SEQ ID NO: 280 are provided in FIG. 10 and in the Sequence Listing. Such functional homologs include, for example, CeresAnnot: 8681689 (SEQ ID NO: 282), GI:226529851 (SEQ ID NO: 283), GI:115448865 (SEQ ID NO: 284), GI:154163107 (SEQ ID NO: 285), GI:147817757 (SEQ ID NO: 286), CeresClone:1925709 (SEQ ID NO: 288), GI:15227566 (SEQ ID NO: 289), GI:20138107 (SEQ ID NO: 290), CeresClone:934069 (SEQ ID NO: 292), CeresAnnot: 8681691 (SEQ ID NO: 294), GI:46805726 (SEQ ID NO: 295), GI:125541250 (SEQ ID NO: 296), GI:115448869 (SEQ ID NO: 297), GI:115467048 (SEQ ID NO: 298), GI:51090521 (SEQ ID NO:299), GI:125554524 (SEQ ID NO:300), CeresAnnot:8735787 (SEQ ID NO:302), GI:15227563 (SEQ ID NO:303), CeresAnnot:8681690 (SEQ ID NO:305), GI:15223062 (SEQ ID NO:306), CeresAnnot:8735782 (SEQ ID NO:308), GI:115467046 (SEQ ID NO:309), GI:125554519 (SEQ ID NO:310), GI:125596466 (SEQ ID NO:311), GI:20138442 (SEQ ID NO:312), CeresAnnot:1448326 (SEQ ID NO:314), CeresAnnot:8735776 (SEQ ID NO:316), GI:125554515 (SEQ ID NO:317), GI:154163097 (SEQ ID NO:318), CeresAnnot:8673445 (SEQ ID NO:320), GI:115445521 (SEQ ID NO:321), CeresAnnot:1448328 (SEQ ID NO:323), CeresAnnot:1437779 (SEQ ID NO:325), GI:15226507 (SEQ ID NO:326), GI:154163099 (SEQ ID NO:327), GI:93139696 (SEQ ID NO:328), GI:154163101 (SEQ ID NO:329), CeresAnnot:1448327 (SEQ ID NO:331), CeresAnnot:8681687 (SEQ ID NO:333), CeresAnnot:1437782 (SEQ ID NO:335), GI:20138443 (SEQ ID NO:336), GI:15226501 (SEQ ID NO:337), GI:125541240 (SEQ ID NO:338), GI:115458656 (SEQ ID NO:339), GI:125548499 (SEQ ID NO:340), (CeresAnnot:8654550SEQ ID NO:342), CeresAnnot:8701112 (SEQ ID NO:344), and CeresClone:1530993 (SEQ ID NO:346). In some cases, a functional homolog of SEQ ID NO: 280 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 280. In some cases, a functional homolog of SEQ ID NO: 280 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 280 described above or set forth in the Sequence Listing.

Examples of amino acid sequences of functional homologs of the polypeptide set forth in SEQ ID NO: 641 are provided in FIG. 11 and in the Sequence Listing. Such functional homologs include, for example, CeresAnnot:8744420 (SEQ ID NO: 643), CeresClone:331385 (SEQ ID NO: 645), GI:115469712 (SEQ ID NO:646), GI:1890577 (SEQ ID NO:647), GI:51039064 (SEQ ID NO:648), GI:14330332 (SEQ ID NO:649), GI:147854712 (SEQ ID NO:650), GI:157352236 (SEQ ID NO:651), GI:118722746 (SEQ ID NO:652), GI:8886867 (SEQ ID NO:653), GI:115334952 (SEQ ID NO:654), CeresClone:1789502 (SEQ ID NO:656), CeresClone:1805428 (SEQ ID NO:658), CeresClone:1724099 (SEQ ID NO:660), CeresClone:1724817 (SEQ ID NO:662), CeresClone:1804995 (SEQ ID NO:664), CeresClone:1446366 (SEQ ID NO:666), CeresClone:1054422 (SEQ ID NO:668), CeresClone:263803 (SEQ ID NO:670), CeresClone:1821034 (SEQ ID NO:672), CeresClone:1806021 (SEQ ID NO:674), CeresClone:1727689 (SEQ ID NO:676), GI:115469720 (SEQ ID NO:677), CeresAnnot:8744425 (SEQ ID NO:679), GI:212275237 (SEQ ID NO:680), CeresClone:1724271 (SEQ ID NO:682), CeresClone:247073 (SEQ ID NO:684), CeresClone:1020658 (SEQ ID NO:686), GI:1890575 (SEQ ID NO:687), GI:225446111 (SEQ ID NO:688), GI:225446115 (SEQ ID NO:689), GI:147854714 (SEQ ID NO:690), GI:68532877 (SEQ ID NO:691), GI:147779866 (SEQ ID NO:692), CeresClone:100062911 (SEQ ID NO:694), GI:225446117 (SEQ ID NO:695), CeresClone:1832719 (SEQ ID NO:697), CeresClone:1793297 (SEQ ID NO:699), CeresClone:1848637 (SEQ ID NO:701), GI:225446103 (SEQ ID NO:702), CeresAnnot:1362908 (SEQ ID NO:704), CeresClone:100064069 (SEQ ID NO:706), CeresAnnot:1469128 (SEQ ID NO:708), CeresClone:656868 (SEQ ID NO:710), CeresClone:1793334 (SEQ ID NO:712), GI:29500891 (SEQ ID NO:713), CeresClone:1895226 (SEQ ID NO:715), GI:8886865 (SEQ ID NO:716), CeresAnnot:878947 (SEQ ID NO:718), CeresClone:1045431 (SEQ ID NO:720), GI:22947852 (SEQ ID NO:721), CeresClone:1855067 (SEQ ID NO:723), GI:17064792 (SEQ ID NO:724), CeresClone:662227 (SEQ ID NO:726), GI:225446109 (SEQ ID NO:727), CeresClone:522574 (SEQ ID NO:729), GI: 115334954 (SEQ ID NO:730), CeresClone:581426 (SEQ ID NO:732), GI:124109191 (SEQ ID NO:733), CeresAnnot:1471882 (SEQ ID NO:735), GI:34809190 (SEQ ID NO:736), GI:29500893 (SEQ ID NO:737), CeresAnnot:1452398 (SEQ ID NO:739), GI:124109199 (SEQ ID NO:740), CeresAnnot:1478206 (SEQ ID NO:742), CeresAnnot:1445599 (SEQ ID NO:744), CeresAnnot:1452397 (SEQ ID NO:746), GI:19911573 (SEQ ID NO:747), GI:124109181 (SEQ ID NO:748), GI:22327914 (SEQ ID NO:749), GI:42795468 (SEQ ID NO:750), GI:42795462 (SEQ ID NO:751), CeresAnnot:1466060 (SEQ ID NO:753), CeresAnnot:8461207 (SEQ ID NO:755), CeresAnnot:1506985 (SEQ ID NO:757), GI:3901012 (SEQ ID NO:758), CeresAnnot:1443040 (SEQ ID NO:760), GI:90811697 (SEQ ID NO:761), CeresAnnot:1443041 (SEQ ID NO:763), GI:157358970 (SEQ ID NO:764), GI:90656516 (SEQ ID NO:765), GI:577066 (SEQ ID NO:766), GI:90656520 (SEQ ID NO:767), GI:88683124 (SEQ ID NO:768), GI:90656518 (SEQ ID NO:769), CeresAnnot:1482565 (SEQ ID NO:771), GI:15238891 (SEQ ID NO:772), and Ceres Clone ID No. 933491 (SEQ ID NO: 823). In some cases, a functional homolog of SEQ ID NO: 641 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 641. In some cases, a functional homolog of SEQ ID NO: 641 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 641 described above or set forth in the Sequence Listing.

Figure 12:
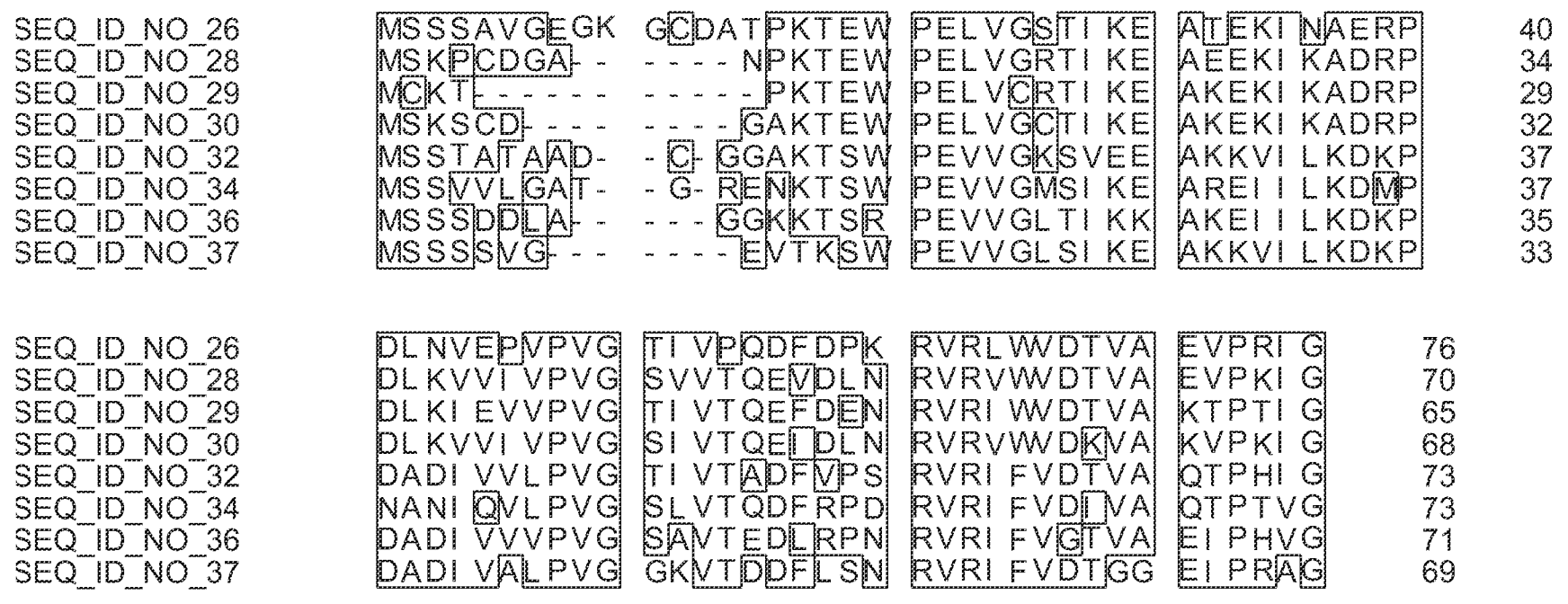

Examples of amino acid sequences of functional homologs of the polypeptide set forth in SEQ ID NO: 26 are provided in FIG. 12 and in the Sequence Listing. Such functional homologs include, for example, CeresClone:570179 (SEQ ID NO: 28), GI:54290293 (SEQ ID NO:29), GI:1617121 (SEQ ID NO:30), CeresAnnot:8724383 (SEQ ID NO:32), CeresClone:896724 (SEQ ID NO:34), CeresClone:607452 (SEQ ID NO:36), GI:37904392 (SEQ ID NO:37), CeresClone:1870473 (SEQ ID NO:39), CeresClone:2026564 (SEQ ID NO:41), CeresClone:2004365 (SEQ ID NO:43), CeresClone:2020677 (SEQ ID NO:45), CeresClone:2039538 (SEQ ID NO:47), CeresClone:844611 (SEQ ID NO:49), GI:125526847 (SEQ ID NO:50), CeresClone:597887 (SEQ ID NO:52), GI:58396949 (SEQ ID NO:53), CeresClone:684778 (SEQ ID NO:55), CeresClone:699511 (SEQ ID NO:57), CeresClone:1803377 (SEQ ID NO:59), CeresClone:1888961 (SEQ ID NO:61), CeresClone:897331 (SEQ ID NO:63), CeresClone:617775 (SEQ ID NO:65), GI:20513866 (SEQ ID NO:66), CeresAnnot:8724387 (SEQ ID NO:68), CeresClone:1804405 (SEQ ID NO:70), GI:48093396 (SEQ ID NO:71), GI:108862602 (SEQ ID NO:72), GI:115488400 (SEQ ID NO:73), CeresClone:759663 (SEQ ID NO:75), CeresClone:1801827 (SEQ ID NO:77), GI:48093418 (SEQ ID NO:78), GI:48093360 (SEQ ID NO:79), CeresClone:1457620 (SEQ ID NO:81), GI:48093370 (SEQ ID NO:82), CeresClone:639183 (SEQ ID NO:84), CeresClone:1453564 (SEQ ID NO:86), CeresClone:1531954 (SEQ ID NO:88), CeresClone:1460371 (SEQ ID NO:90), CeresClone:1627479 (SEQ ID NO:92), CeresClone:992630 (SEQ ID NO:94), CeresClone:685480 (SEQ ID NO:96), GI:75994159 (SEQ ID NO:97), CeresAnnot:8724380 (SEQ ID NO:99), GI:48093378 (SEQ ID NO:100), GI:75994143 (SEQ ID NO:101), GI:75994153 (SEQ ID NO:102), CeresAnnot:8724381 (SEQ ID NO:104), GI:75994157 (SEQ ID NO:105), CeresClone:730301 (SEQ ID NO:107), and CeresAnnot:8724388 (SEQ ID NO:109). In some cases, a functional homolog of SEQ ID NO: 26 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 26. In some cases, a functional homolog of SEQ ID NO: 26 has an amino acid sequence with at least 45% sequence identity, e.g., 50%, $5^2$%, 56%, 59%, 61%, 65%, 70%, 75%, 80%, 85%, 90%, 95%, 97%, 98%, or 99% sequence identity, to one or more functional homologs of SEQ ID NO: 26 described above or set forth in the Sequence Listing.

The identification of conserved regions in a biomass composition-modulating polypeptide facilitates production of variants of biomass composition-modulating polypeptides. Variants of biomass composition-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, FIG. 4, FIG. 5, FIG. 6, FIG. 7, FIG. 8, FIG. 9, FIG. 10, FIG. 11, or FIG. 12, and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at a position marked by dashes, such a polypeptide has a length that is the sum of the amino acid residues in all conserved regions and all dashes.

C. Functional Homologs Identified by HMMER

In some embodiments, useful biomass composition-modulating polypeptides include those that fit a Hidden Markov Model based on the polypeptides set forth in any one of FIGS. 1-12. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, —consistency REPS of 2; -ir, —iterative-refinement REPS of 100; -pre, —pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate biomass composition-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The biomass composition-modulating polypeptides discussed below fit the indicated HMM with an HMM bit score greater than to 65. (e.g., greater than 70, 80, 90, 100, 120, 140, 200, 300, 500, 1000, 1500, or 2000). In some embodiments, the HMM bit score of a biomass composition-modulating polypeptide discussed below is about 50%, 60%, 70%, 80%, 90%, or 95% of the HMM bit score of a functional homolog provided in the Sequence Listing of this application. In some embodiments, a biomass composition-modulating polypeptide discussed below fits the indicated HMM with an HMM bit score greater than 210, and has a domain indicative of a biomass composition-modulating polypeptide. In some embodiments, a biomass composition-modulating polypeptide discussed below fits the indicated HMM with an HMM bit score greater than 210, and has 65% or greater sequence identity (e.g., 75%, 80%, 85%, 90%, 95%, or 100% sequence identity) to an amino acid sequence shown in any one of FIGS. 1-12.

Examples of polypeptides are shown in the sequence listing that have HMM bit scores greater than 84 (e.g., greater than 100, 120, 140, 160, 180, 200, 220, 240, 250, 260, 270, 280, or 290) when fitted to an HMM generated from the amino acid sequences set forth in FIG. 1 are identified in the Sequence Listing of this application. Such polypeptides include, for example, SEQ ID NOs: 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, and 559.

Examples of polypeptides are shown in the sequence listing that have HMM bit scores greater than 120 (e.g., greater than 125, 130, 140, 150, 160, 170, 180, 200, 220, 240, 260, 280, 300, or 315) when fitted to an HMM generated from the amino acid sequences set forth in FIG. 2 are identified in the Sequence Listing of this application. Such polypeptides include, for example, SEQ ID NOs: 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, and 638.

Examples of polypeptides are shown in the sequence listing that have HMM bit scores greater than 200 (e.g., greater than 250, 300, 350, 400, 450, 500, 550, 600, 650, 700, 750, 800, 850, 900, 950, 975, or 1000) when fitted to an HMM generated from the amino acid sequences set forth in FIG. 3 are identified in the Sequence Listing of this application. Such polypeptides include, for example, SEQ ID NOs: 246, 248, 250, 251, 252, 254, 256, 258, 260, 261, 262, 264, 266, 268, 270, 272, 274, 275, 276, and 278.

Examples of polypeptides are shown in the sequence listing that have HMM bit scores greater than 93 (e.g., greater than 95, 100, 105, 110, 115, 120, 125, 130, 135, 140, or 145) when fitted to an HMM generated from the amino acid sequences set forth in FIG. 4 are identified in the Sequence Listing of this application. Such polypeptides include, for example, SEQ ID NOs: 111, 113, 115, 117, 118, 120, 122, 124, 126, 128, 130, 132, 133, 135, 136, 138, 139, 141, 143, 145, 147, 148, 149, 151, 152, 153, and 155.

Examples of polypeptides are shown in the sequence listing that have HMM bit scores greater than 387 (e.g., greater than 400, 450, 500, 550, 600, 650, 700, 750, 800, 850, 900, or 920) when fitted to an HMM generated from the amino acid sequences set forth in FIG. 5 are identified in the Sequence Listing of this application. Such polypeptides include, for example, SEQ ID NOs: 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, and 414.

Examples of polypeptides are shown in the sequence listing that have HMM bit scores greater than 315 (e.g., greater than 350, 400, 450, 500, 550, 600, 650, 700, 750, 800, 850, 900, 950, 1000, 1050, 1100, 1150, 1200, 1250, 1300, 1350, 1400, 1450, 1500, 1500, 1550, 1600, 1620, 1630, or 1640) when fitted to an HMM generated from the amino acid sequences set forth in FIG. 6 are identified in the Sequence Listing of this application. Such polypeptides include, for example, SEQ ID NOs: 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, and 821.

Examples of polypeptides are shown in the sequence listing that have HMM bit scores greater than 914 (e.g., greater than 920, 940, 960, 980, 1000, 1020, 1040, 1060, 1080, 1090, or 1100) when fitted to an HMM generated from the amino acid sequences set forth in FIG. 7 are identified in the Sequence Listing of this application. Such polypeptides include, for example, SEQ ID NOs: 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, and 481.

Examples of polypeptides are shown in the sequence listing that have HMM bit scores greater than 659 (e.g., greater than 675, 700, 800, 900, 1000, 1050, 1100, 1150, 1200, 1250, 1300, 1350, 1400, 1425, or 1440) when fitted to an HMM generated from the amino acid sequences set forth in FIG. 8 are identified in the Sequence Listing of this application. Such polypeptides include, for example, SEQ ID NOs: 2, 4, 6, 7, 8, 10, 12, 14, 15, 17, 18, 19, 20, 21, 22, and 24. In some embodiments, an HMM can be generated based on the amino acid sequences set forth in FIG. 8 that are truncated at about residue 142.

Examples of polypeptides are shown in the sequence listing that have HMM bit scores greater than 406 (e.g., greater than 420, 450, 500, 550, 600, 650, 700, 750, 800, 850, 900, 950, 1000, 1050, 1100, 1150, 1200, 1250, 1300, 1350, 1400, 1420, or 1440) when fitted to an HMM generated from the amino acid sequences set forth in FIG. 9 are identified in the Sequence Listing of this application. Such polypeptides include, for example, SEQ ID NOs: 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, and 244.

Examples of polypeptides are shown in the sequence listing that have HMM bit scores greater than 640 (e.g., greater than 650, 700, 750, 800, 850, 900, 950, 1000, 1050, 1100, 1150, 1200, 1250, 1300, 1350, 1400, 1450, 1500, or 1510), when fitted to an HMM generated from the amino acid sequences set forth in FIG. 10 are identified in the Sequence Listing of this application. Such polypeptides include, for example, SEQ ID NOs: 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, and 346.

Examples of polypeptides are shown in the sequence listing that have HMM bit scores greater than 234 (e.g., greater than 250, 275, 300, 325, 350, 375, 400, 424, 450, 475, 500, 525, 550, 575, 600, 626, 650, 675, 700, or 720) when fitted to an HMM generated from the amino acid sequences set forth in FIG. 11 are identified in the Sequence Listing of this application. Such polypeptides include, for example, SEQ ID NOs: 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, and 823.

Examples of polypeptides are shown in the sequence listing that have HMM bit scores greater than 131 (e.g., greater than 135, 140, 145, 150, 151, 152, 153, or 154) when fitted to an HMM generated from the amino acid sequences set forth in FIG. 12 are identified in the Sequence Listing of this application. Such polypeptides include, for example, SEQ ID NOs: 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, and 109.

D. Percent Identity

In some embodiments, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823. Polypeptides having such a percent sequence identity often have a domain indicative of a biomass composition-modulating polypeptide and/or have an HMM bit score that is greater than 65, as discussed above. Amino acid sequences of biomass composition-modulating polypeptides having at least 80% sequence identity to one of the amino acid sequences set forth in SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823 are provided in FIGS. 1-12 and in the Sequence Listing.

"Percent sequence identity" refers to the degree of sequence identity between any given reference sequence, e.g., SEQ ID NO: 1, and a candidate biomass composition-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., *Nucleic Acids Res.*, 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 483. Amino acid sequences of polypeptides having greater than 45% sequence identity to the polypeptide set forth in SEQ ID NO: 483 are provided in FIG. 1 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 562. Amino acid sequences of polypeptides having greater than 45% sequence identity to the polypeptide set forth in SEQ ID NO: 562 are provided in FIG. 2 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 246. Amino acid sequences of polypeptides having greater than 45% sequence identity to the polypeptide set forth in SEQ ID NO: 246 are provided in FIG. 3 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 111. Amino acid sequences of polypeptides having greater than 45% sequence identity to the polypeptide set forth in SEQ ID NO: 111 are provided in FIG. 4 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 348. Amino acid sequences of polypeptides having greater than 45% sequence identity to the polypeptide set forth in SEQ ID NO: 348 are provided in FIG. 5 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 774. Amino acid sequences of polypeptides having greater than 45% sequence identity to the polypeptide set forth in SEQ ID NO: 774 are provided in FIG. 6 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 416. Amino acid sequences of polypeptides having greater than 45% sequence identity to the polypeptide set forth in SEQ ID NO: 416 are provided in FIG. 7 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. Amino acid sequences of polypeptides having greater than 45% sequence identity to the polypeptide set forth in SEQ ID NO: 2 are provided in FIG. 8 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 157. Amino acid sequences of polypeptides having greater than 45% sequence identity to the polypeptide set forth in SEQ ID NO: 157 are provided in FIG. 9 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 280. Amino acid sequences of polypeptides having greater than 45% sequence identity to the polypeptide set forth in SEQ ID NO: 280 are provided in FIG. 10 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 641. Amino acid sequences of polypeptides having greater than 45% sequence identity to the polypeptide set forth in SEQ ID NO: 641 are provided in FIG. 11 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 26. Amino acid sequences of polypeptides having greater than 45% sequence identity to the polypeptide set forth in SEQ ID NO: 26 are provided in FIG. 12 and in the Sequence Listing.

E. Other Sequences

It should be appreciated that a biomass composition-modulating polypeptide can include additional amino acids that are not involved in biomass modulation, and thus such a polypeptide can be longer than would otherwise be the case. For example, a biomass composition-modulating polypeptide can include a purification tag, a chloroplast transit peptide, a mitochondrial transit peptide, an amyloplast peptide, or a leader sequence added to the amino or carboxy terminus. In some embodiments, a biomass composition-modulating polypeptide includes an amino acid sequence that functions as a reporter, e.g., a green fluorescent protein or yellow fluorescent protein.

III. Nucleic Acids

Nucleic acids described herein include nucleic acids that are effective to modulate biomass composition when transcribed in a plant or plant cell. Such nucleic acids include, without limitation, those that encode a biomass composition-modulating polypeptide and those that can be used to inhibit expression of a biomass composition-modulating polypeptide via a nucleic acid based method.

A. Nucleic Acids Encoding Biomass Composition-Modulating Polypeptides

Nucleic acids encoding biomass composition-modulating polypeptides are described herein. Examples of such nucleic acids include SEQ ID NOs: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822.

A biomass composition-modulating nucleic acid can comprise the nucleotide sequence set forth in SEQ ID NO: 482. Alternatively, a biomass composition-modulating nucleic acid can be a variant of the nucleic acid having the nucleotide sequence set forth in SEQ ID NO: 482. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 482.

A biomass composition-modulating nucleic acid can comprise the nucleotide sequence set forth in SEQ ID NO: 561. Alternatively, a biomass composition-modulating nucleic acid can be a variant of the nucleic acid having the nucleotide sequence set forth in SEQ ID NO: 561. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 561.

A biomass composition-modulating nucleic acid can comprise the nucleotide sequence set forth in SEQ ID NO: 245. Alternatively, a biomass composition-modulating nucleic acid can be a variant of the nucleic acid having the nucleotide sequence set forth in SEQ ID NO: 245. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 245.

A biomass composition-modulating nucleic acid can comprise the nucleotide sequence set forth in SEQ ID NO: 110. Alternatively, a biomass composition-modulating nucleic acid can be a variant of the nucleic acid having the nucleotide sequence set forth in SEQ ID NO: 110. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 110.

A biomass composition-modulating nucleic acid can comprise the nucleotide sequence set forth in SEQ ID NO: 347. Alternatively, a biomass composition-modulating nucleic acid can be a variant of the nucleic acid having the nucleotide sequence set forth in SEQ ID NO: 347. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 347.

A biomass composition-modulating nucleic acid can comprise the nucleotide sequence set forth in SEQ ID NO: 773. Alternatively, a biomass composition-modulating nucleic acid can be a variant of the nucleic acid having the nucleotide sequence set forth in SEQ ID NO: 773. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 773.

A biomass composition-modulating nucleic acid can comprise the nucleotide sequence set forth in SEQ ID NO: 415. Alternatively, a biomass composition-modulating nucleic acid can be a variant of the nucleic acid having the nucleotide sequence set forth in SEQ ID NO: 415. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 415.

A biomass composition-modulating nucleic acid can comprise the nucleotide sequence set forth in SEQ ID NO: 1 or a fragment of the nucleotide sequence set forth in SEQ ID NO: 1. For example, a deletion can be made at nucleotide position 657 of SEQ ID NO: 1 such that a truncated protein is encoded (e.g., a truncated protein having about 142 residues). Alternatively, a biomass composition-modulating nucleic acid can be a variant of the nucleic acid having the nucleotide sequence set forth in SEQ ID NO: 1. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1. Such variant biomass composition-modulating nucleotide sequences can have a deletion at the nucleotide position corresponding to position 657 of SEQ ID NO: 1 such that a truncated protein is encoded.

A biomass composition-modulating nucleic acid can comprise the nucleotide sequence set forth in SEQ ID NO: 156. Alternatively, a biomass composition-modulating nucleic acid can be a variant of the nucleic acid having the nucleotide sequence set forth in SEQ ID NO: 156. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 156.

A biomass composition-modulating nucleic acid can comprise the nucleotide sequence set forth in SEQ ID NO: 279. Alternatively, a biomass composition-modulating nucleic acid can be a variant of the nucleic acid having the nucleotide sequence set forth in SEQ ID NO: 279. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 279.

A biomass composition-modulating nucleic acid can comprise the nucleotide sequence set forth in SEQ ID NO: 640. Alternatively, a biomass composition-modulating nucleic acid can be a variant of the nucleic acid having the nucleotide sequence set forth in SEQ ID NO: 640. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 640.

A biomass composition-modulating nucleic acid can comprise the nucleotide sequence set forth in SEQ ID NO: 25. Alternatively, a biomass composition-modulating nucleic acid can be a variant of the nucleic acid having the nucleotide sequence set forth in SEQ ID NO: 25. For example, a biomass composition-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 25.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Biomass Composition-Modulating Polypeptide A nucleic acid encoding one of the biomass composition-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular biomass composition-modulating polypeptide; i.e., for many amino acids, there is more than one nucleotide triplet that serves as the codon for the amino acid. Thus, codons in the coding sequence for a given biomass composition-modulating polypeptide can be modified such that optimal expression in a particular plant species is obtained, using appropriate codon bias tables for that species.

In some cases, expression of a biomass composition-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of a Biomass Composition-Modulating Polypeptide

Polynucleotides and recombinant constructs described herein can be used to inhibit expression of a biomass composition-modulating polypeptide in a plant species of interest. See, e.g., Matzke and Birchler, *Nature Reviews Genetics* 6:24-35 (2005); Akashi et al., *Nature Reviews Mol. Cell Biology* 6:413-422 (2005); Mittal, *Nature Reviews Genetics* 5:355-365 (2004); *and Nature Reviews RNA interference collection*, October 2005 on the World Wide Web at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding biomass composition-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254, 678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, NJ. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a biomass composition-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the biomass composition-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a biomass composition-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the biomass composition-modulating polypeptide. In other embodiments, one strand of the stem portion of a double stranded RNA comprises a sequence that is similar or identical to the sequence of an intron, or a fragment thereof, in the pre-mRNA encoding a biomass composition-modulating polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a biomass composition-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a biomass composition-modulating polypeptide, or a fragment of such sequences. In some embodiments, the sense or antisense sequence is identical or complementary to a sequence of the regulatory region that drives transcription of the gene encoding a biomass composition-modulating polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a biomass composition-modulating polypeptide described herein. The sense sequence complementary to the antisense sequence can be a sequence present within the mRNA of the biomass composition-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences or the left and right border-like sequences of the P-DNA flank, or are on either side of, the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, *Antisense Nucleic Acid Drug Dev.*, 7:187-195 (1997); Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate biomass levels. A recombinant nucleic acid construct can comprise a nucleic acid encoding a biomass composition-modulating polypeptide as described herein, operably linked to a regulatory region suitable for expressing the biomass composition-modulating polypeptide in the plant or cell. Thus, a nucleic acid can comprise a coding sequence that encodes a biomass composition-modulating polypeptides as set forth in SEQ ID NOs: 2, 4, 6, 7, 8, 10, 12, 14, 15, 17, 18, 19, 20, 21, 22, 24, 26, 28, 29, 30, 32, 34, 36, 37, 39, 41, 43, 45, 47, 49, 50, 52, 53, 55, 57, 59, 61, 63, 65, 66, 68, 70, 71, 72, 73, 75, 77, 78, 79, 81, 82, 84, 86, 88, 90, 92, 94, 96, 97, 99, 100, 101, 102, 104, 105, 107, 109, 111, 113, 115, 117, 118, 120, 122, 124, 126, 128, 130, 132, 133, 135, 136, 138, 139, 141, 143, 145, 147, 148, 149, 151, 152, 153, 155, 157, 158, 160, 161, 162, 163, 164, 165, 167, 168, 170, 171, 172, 173, 175, 177, 179, 181, 182, 184, 185, 187, 189, 190, 192, 194, 196, 197, 199, 201, 202, 204, 205, 207, 208, 210, 211, 213, 215, 216, 218, 220, 221, 222, 223, 225, 226, 228, 230, 232, 234, 236, 238, 240, 242, 244, 246, 248, 250, 251, 252, 254, 256, 258, 260, 261, 262, 264, 266, 268, 270, 272, 274, 275, 276, 278, 280, 282, 283, 284, 285, 286, 288, 289, 290, 292, 294, 295, 296, 297, 298, 299, 300, 302, 303, 305, 306, 308, 309, 310, 311, 312, 314, 316, 317, 318, 320, 321, 323, 325, 326, 327, 328, 329, 331, 333, 335, 336, 337, 338, 339, 340, 342, 344, 346, 348, 350, 351, 353, 355, 357, 359, 360, 361, 362, 363, 364, 365, 366, 368, 370, 372, 373, 374, 375, 376, 377, 379, 380, 381, 383, 384, 386, 388, 390, 392, 393, 394, 396, 398, 400, 402, 404, 406, 407, 408, 410, 412, 413, 414, 416, 418, 419, 420, 422, 423, 424, 426, 427, 429, 430, 431, 433, 434, 436, 437, 439, 441, 442, 444, 446, 448, 449, 450, 451, 452, 454, 456, 458, 459, 460, 462, 463, 465, 466, 468, 470, 472, 473, 474, 476, 478, 479, 480, 481, 483, 485, 486, 488, 490, 492, 493, 495, 497, 498, 500, 501, 503, 504, 506, 508, 509, 510, 512, 514, 515, 516, 517, 519, 521, 522, 523, 525, 527, 529, 531, 533, 534, 535, 537, 539, 541, 543, 545, 547, 549, 551, 552, 554, 556, 557, 559, 562, 564, 565, 567, 568, 570, 572, 573, 574, 575, 576, 578, 580, 582, 584, 586, 588, 589, 590, 592, 594, 596, 598, 599, 601, 602, 603, 605, 607, 608, 609, 611, 613, 615, 617, 619, 621, 622, 624, 625, 627, 629, 630, 632, 634, 636, 638, 641, 643, 645, 646, 647, 648, 649, 650, 651, 652, 653, 654, 656, 658, 660, 662, 664, 666, 668, 670, 672, 674, 676, 677, 679, 680, 682, 684, 686, 687, 688, 689, 690, 691, 692, 694, 695, 697, 699, 701, 702, 704, 706, 708, 710, 712, 713, 715, 716, 718, 720, 721, 723, 724, 726, 727, 729, 730, 732, 733, 735, 736, 737, 739, 740, 742, 744, 746, 747, 748, 749, 750, 751, 753, 755, 757, 758, 760, 761, 763, 764, 765, 766, 767, 768, 769, 771, 772, 774, 775, 776, 777, 778, 780, 781, 782, 783, 785, 786, 788, 789, 791, 793, 795, 796, 798, 799, 800, 801, 802, 803, 805, 807, 808, 810, 811, 812, 813, 814, 815, 816, 817, 818, 819, 820, 821, and 823. Examples of nucleic acids encoding biomass composition-modulating polypeptides are set forth in SEQ ID NOs: 1, 3, 5, 9, 11, 13, 16, 23, 25, 27, 31, 33, 35, 38, 40, 42, 44, 46, 48, 51, 54, 56, 58, 60, 62, 64, 67, 69, 74, 76, 80, 83, 85, 87, 89, 91, 93, 95, 98, 103, 106, 108, 110, 112, 114, 116, 119, 121, 123, 125, 127, 129, 131, 134, 137, 140, 142, 144, 146, 150, 154, 156, 159, 166, 169, 174, 176, 178, 180, 183, 186, 188, 191, 193, 195, 198, 200, 203, 206, 209, 212, 214, 217, 219, 224, 227, 229, 231, 233, 235, 237, 239, 241, 243, 245, 247, 249, 253, 255, 257, 259, 263, 265, 267, 269, 271, 273, 277, 279, 281, 287, 291, 293, 301, 304, 307, 313, 315, 319, 322, 324, 330, 332, 334, 341, 343, 345, 347, 349, 352, 354, 356, 358, 367, 369, 371, 378, 382, 385, 387, 389, 391, 395, 397, 399, 401, 403, 405, 409, 411, 415, 417, 421, 425, 428, 432, 435, 438, 440, 443, 445, 447, 453, 455, 457, 461, 464, 467, 469, 471, 475, 477, 482, 484, 487, 489, 491, 494, 496, 499, 502, 505, 507, 511, 513, 518, 520, 524, 526, 528, 530, 532, 536, 538, 540, 542, 544, 546, 548, 550, 553, 555, 558, 560, 561, 563, 566, 569, 571, 577, 579, 581, 583, 585, 587, 591, 593, 595, 597, 600, 604, 606, 610, 612, 614, 616, 618, 620, 623, 626, 628, 631, 633, 635, 637, 639, 640, 642, 644, 655, 657, 659, 661, 663, 665, 667, 669, 671, 673, 675, 678, 681, 683, 685, 693, 696, 698, 700, 703, 705, 707, 709, 711, 714, 717, 719, 722, 725, 728, 731, 734, 738, 741, 743, 745, 752, 754, 756, 759, 762, 770, 773, 779, 784, 787, 790, 792, 794, 797, 804, 806, 809, and 822, or in the Sequence Listing.

The biomass composition-modulating polypeptide encoded by a recombinant nucleic acid can be a native biomass composition-modulating polypeptide, or can be heterologous to the cell. In some cases, the recombinant construct contains a nucleic acid that inhibits expression of a biomass composition-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen® (Madison, WI), Clontech® (Palo Alto, CA), Stratagene® (La Jolla, CA), and Invitrogen/Life Technologies® (Carlsbad, CA).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, CT) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell,* 1:855-866 (1989); Bustos et al., *Plant Cell,* 1:839-854 (1989); Green et al., *EMBO J.,* 7:4035-4044 (1988); Meier et al., *Plant Cell,* 3:309-316 (1991); and Zhang et al., *Plant Physiology,* 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; PCT/US07/62762; PCT/US2009/032485; and PCT/US2009/038792.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA,* 86:7890-7894 (1989)), root cell specific promoters reported by Conkling et al., *Plant Physiol.,* 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell,* 1(9):839-853 (1989)), the soybean trypsin inhibitor promoter (Riggs et al., *Plant Cell,* 1(6):609-621 (1989)), the ACP promoter (Baerson et al., *Plant Mol. Biol.,* 22(2):255-267 (1993)), the stearoyl-ACP desaturase promoter (Slocombe et al., *Plant Physiol.,* 104(4):167-176 (1994)), the soybean α' subunit of β-conglycinin promoter (Chen et al., *Proc. Natl. Acad. Sci. USA,* 83:8560-8564 (1986)), the oleosin promoter (Hong et al., *Plant Mol. Biol.,* 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.,* 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao, *Plant Mol. Biol.,* 32:571-57 (1996); Conceicao, *Plant,* 5:493-505 (1994)); *Arabidopsis* FIE (GenBankNo. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan, *Genetics,* 142:1009-1020 (1996)); maize Cat3 (see, GenBank No. L05934; Abler, *Plant Mol. Biol.,* 22:10131-1038 (1993)). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* 20:647-654 (2001)), YP0097, YP0107, YP0088, YP0143, YP0156, PT0650, YP0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the *Commelina* yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

ix. Inducible Promoters

Inducible promoters confer transcription in response to external stimuli such as chemical agents or environmental stimuli. For example, inducible promoters can confer transcription in response to hormones such as gibberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA(b) and CryIA(c) (Braga et al. 2003, Journal of New Seeds 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. In some embodiments, a promoter may preferentially drive expression in reproductive tissues (e.g., P02916 promoter, SEQ ID NO:31 in 61/364,903). Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a biomass composition-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. TRANSGENIC PLANTS AND PLANT CELLS

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous biomass composition-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a biomass composition-modulating polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of biomass. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a biomass level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis*, and *Zea*.

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), *Triticosecale* (*Triticum*—wheat X rye) and bamboo.

Suitable species also include *Helianthus annuus* (sunflower), *Carthamus tinctorius* (safflower), *Jatropha curcas* (*Jatropha*), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava)

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii,* and *Tanacetum parthenium*.

Suitable species also include *Parthenium argentatum* (guayule), *Hevea* spp. (rubber), *Mentha spicata* (mint), *Mentha piperita* (mint), *Bixa orellana,* and *Alstroemeria* spp.

Suitable species also include Rosa spp. (rose), *Dianthus caryophyllus* (carnation), *Petunia* spp. (*petunia*) and *Poinsettia pulcherrima* (Poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

In some embodiments, a suitable species can be a wild, weedy, or cultivated *Pennisetum* species such as, but not limited to, *Pennisetum alopecuroides, Pennisetum arnhemicum, Pennisetum caffrum, Pennisetum clandestinum, Pennisetum divisum, Pennisetum glaucum, Pennisetum latifolium, Pennisetum macrostachyum, Pennisetum macrourum, Pennisetum orientale, Pennisetum pedicellatum, Pennisetum polystachion, Pennisetum polystachion* ssp. *Setosum, Pennisetum purpureum, Pennisetum setaceum, Pennisetum subangustum, Pennisetum typhoides, Pennisetum villosum,* or hybrids thereof (e.g., *Pennisetum purpureum* x *Pennisetum typhoidum*).

In some embodiments, a suitable species can be a wild, weedy, or cultivated *Miscanthus* species and/or variety such as, but not limited to, *Miscanthus* x *giganteus, Miscanthus sinensis, Miscanthus* x *ogiformis, Miscanthus floridulus, Miscanthus transmorrisonensis, Miscanthus oligostachyus, Miscanthus nepalensis, Miscanthus sacchariflorus, Miscanthus* x *giganteus* 'amuri', *Miscanthus* x *giganteus* 'Nagara', *Miscanthus* x *giganteus* 'illinois', *Miscanthus sinensis* var. 'goliath', *Miscanthus sinensis* var. 'roland', *Miscanthus sinensis* var. 'africa', *Miscanthus sinensis* var. 'fern Osten', *Miscanthus sinensis* var. gracillimus, *Miscanthus sinensis* var. variegates, *Miscanthus sinensis* var. purpurascens, *Miscanthus sinensis* var. 'Malepartus', *Miscanthus sacchariflorus* var. 'Robusta', *Miscanthus sinensis* var. 'silberfedher' (aka. Silver Feather), *Miscanthus transmorrisonensis, Miscanthus condensatus, Miscanthus yakushimanum, Miscanthus* var. 'alexander', *Miscanthus* var. 'adagio', *Miscanthus* var. 'Autumn Light', *Miscanthus* var. 'cabaret', *Miscanthus* var. 'condensatus', *Miscanthus* var. 'cosmopolitan', *Miscanthus* var. 'Dixieland', *Miscanthus* var. 'Gilded Tower' (U.S. Pat. No. PP14,743), *Miscanthus* var. 'Gold Bar' (U.S. Pat. No. PP15,193), *Miscanthus* var. '*Gracillimus*', *Miscanthus* var. 'graziella', *Miscanthus* var. 'Grosse Fontaine', *Miscanthus* var. 'Hinjo aka Little Nicky'™, *Miscanthus* var. 'juli', *Miscanthus* var. 'Kaskade', *Miscanthus* var. 'Kirk alexander, *Miscanthus* var. 'Kleine Fontaine', *Miscanthus* var. 'Kleine Silberspinne' (aka. 'Little Silver Spider'), *Miscanthus* var. 'Little Kitten', *Miscanthus* var. 'Little Zebra' (U.S. Pat. No. PP13,008), *Miscanthus* var. 'Lottum', *Miscanthus* var. 'Malepartus', *Miscanthus* var. 'Morning Light', *Miscanthus* var. 'Mysterious Maiden' (U.S. Pat. No. PP16,176), *Miscanthus* var. 'Nippon', *Miscanthus* var. 'November Sunset', *Miscanthus* var. 'Parachute', *Miscanthus* var. 'Positano', *Miscanthus* var. 'Puenktchen'(aka 'Little Dot'), *Miscanthus* var. 'Rigoletto', *Miscanthus* var. 'Sarabande', *Miscanthus* var. 'Silberpfeil' (aka. Silver Arrow), *Miscanthus* var. 'Silverstripe', *Miscanthus* var. 'Super Stripe' (U.S. Pat. No. PP18,161), *Miscanthus* var. 'strictus', or *Miscanthus* var. '*Zebrinus*'.

In some embodiments, a suitable species can be a wild, weedy, or cultivated *Sorghum* species and/or variety such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare,* or hybrids such as *Sorghum* x *almum, Sorghum* x *sudangrass* or *Sorghum* x *drummondii*.

Thus, the methods and compositions can be used over a broad range of plant species, including species from the dicot genera *Brassica, Carthamus, Glycine, Gossypium, Helianthus, Jatropha, Parthenium, Populus,* and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum,* and *Zea*. In some embodiments, a plant is a member of the species *Panicum virgatum* (switchgrass), *Sorghum bicolor* (*Sorghum*, sudangrass), *Miscanthus giganteus* (*Miscanthus*), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp. X *Miscanthus* sp., *Sorghum* sp. X *Miscanthus* sp., e.g., *Panicum virgatum* x *Panicum amarum, Panicum virgatum* x *Panicum amarulum,* and *Pennisetum purpureum* x *Pennisetum typhoidum*).

D. Transgenic Plant Phenotypes

In some embodiments, a plant in which expression of a biomass composition-modulating polypeptide is modulated has increased or decreased levels of sucrose, ash, or cell wall content. A plant in which expression of a biomass composition-modulating polypeptide is modulated also can have increased or decreased conversion efficiency. A component of biomass composition can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level of the biomass component in a corresponding control plant that does not express the transgene. In some embodiments, a plant in which expression of a biomass composition-modulating polypeptide is modulated can have decreased levels of a biomass component. The level can be decreased by at least 2 percent, e.g., 2, 3, 4, 5, 10, 15, 20, 25, 30, 35, or more than 35 percent, as compared to the level in a corresponding control plant that does not express the transgene.

Increases in a component of biomass composition (e.g., sucrose) in such plants can provide improved nutritional availability in geographic locales where intake of plant foods is often insufficient, or for energy production (e.g., conversion efficiency). In some embodiments, decreases in a component of biomass composition in such plants can be useful in energy production.

In some embodiments, a plant in which expression of a biomass composition-modulating polypeptide is modulated can have increased or decreased levels of a biomass component (e.g., sucrose content) in one or more plant tissues, e.g., vegetative tissues, reproductive tissues, or root tissues. For example, the level of a biomass component can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level in a corresponding control plant that does not express the transgene. In some embodiments, a plant in which expression of a biomass composition-modulating polypeptide is modulated can have decreased levels of a biomass component in one or more plant tissues. The level can be decreased by at least 2 percent, e.g., 2, 3, 4, 5, 10, 15, 20, 25, 30, 35, or more than 35 percent, as compared to the level in a corresponding control plant that does not express the transgene.

Typically, a difference in the amount of a biomass component in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the amount of a biomass component is statistically significant at $p<0.01$, $p<0.005$, or $p<0.001$. A statistically significant difference in, for example, the amount of a biomass component in a transgenic plant compared to the amount of a control plant indicates that the recombinant nucleic acid present in the transgenic plant results in altered biomass composition.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

Biomass can include harvestable plant tissues such as leaves, stems, and reproductive structures, or all plant tissues such as leaves, stems, roots, and reproductive structures. In some embodiments, biomass encompasses only above ground plant parts. In some embodiments, biomass encompasses only stem plant parts. In some embodiments, biomass encompasses only above ground plant parts except inflorescence and seed parts of a plant. Biomass can be measured as described in the examples section. Biomass can be quantified as dry matter yield, which is the mass of biomass produced (usually reported in T/acre) if the contribution of water is subtracted from the fresh mater weight. Dry matter yield (DMY) yield is calculated using the fresh matter weight (FMW) and a measurement of weight percent moisture (M) in the following equation. $DMY=((100-M)/100)*FMW$. Biomass can be quantified as fresh matter yield, which is the mass of biomass produced (usually reported in T/acre) on an as-received basis, which includes the weight of moisture.

V. Modifying Endogenous Nucleic Acids Encoding Biomass Composition-Modulating Polypeptides This document also features plant cells and plants in which an endogenous biomass composition-modulating nucleic acid described herein has been modified (e.g., a regulatory region, intron, or coding region of the biomass composition-modulating nucleic acid has been modified). The biomass composition of such plants is altered relative to the corresponding composition of a control plant in which the endogenous nucleic acid is not modified. Such plants are referred to herein as modified plants and may be used to produce, for example, increased amounts of a biomass component (e.g., sucrose).

Endogenous nucleic acid can be modified by homologous recombination techniques. For example, sequence specific endonucleases (e.g., zinc finger nucleases (ZFNs)) and meganucleases can be used to stimulate homologous recombination at endogenous plant genes. See, e.g., Townsend et al., *Nature* 459:442-445 (2009); Tovkach et al., *Plant J.*, 57:747-757 (2009); and Lloyd et al., *Proc. Natl. Acad. Sci. USA*, 102:2232-2237 (2005). In particular, ZFNs engineered to create DNA double strand breaks at specific loci can be used to make targeted sequence changes in endogenous plant genes. For example, an endogenous plant gene can be replaced with a variant containing one or more mutations (e.g., produced using site-directed mutagenesis or directed evolution). In some embodiments, site directed mutagenesis is achieved via non-homologous end joining such that after breaking DNA, endogenous DNA repair mechanisms ligate the break, often introducing slight deletions or additions that can be screened at the cell or plant level for desired phenotypes. Moore and Haber, *Mol Cell Biol.*, 16(5):2164-73 (1996).

In some embodiments, endogenous nucleic acids can be modified by methylation or demethylation such that the expression of the modified endogenous nucleic acid is altered. For example, a double stranded RNA can be used to activate gene expression by targeting noncoding regulatory regions in gene promoters. See Shibuya et al., *Proc Natl*

*Acad Sci USA,* 106(5): 1660-1665 (2009); and Li et al., *Proc Natl Acad Sci USA,* 103(46):17337-42 (2006). In some embodiments, ZFNs engineered to create DNA double strand breaks at specific loci can be used to insert a DNA fragment having at least one region that overlaps with the endogenous DNA to facilitate homologous recombination, such that the non-overlapping portion of the DNA fragment is integrated at the break site. For example, a fragment can be inserted into an endogenous promoter and/or regulatory region at a specific site where a ZFN created a double stranded break to alter the expression of an endogenous gene. For example, a fragment that is inserted into an endogenous gene coding region at a specific site where a ZFN created a double stranded break can result in expression of a chimeric gene. For example, a fragment that functions as a regulatory region or promoter that is inserted into an endogenous DNA region immediately upstream of a gene coding sequence at a specific site where a ZFN creates a double strand break can result in altered expression of the endogenous gene.

In some embodiments, endogenous nucleic acids can be modified using activation tagging. For example, a vector containing multiple copies of an enhancer element from the constitutively active promoter of the cauliflower mosaic virus (CaMV) 35S gene can be used to activate an endogenous gene. See, Weigel et al., *Plant Physiology,* 122:1003-1013 (2000).

In some embodiments, endogenous nucleic acids can be modified by introducing an engineered transcription activation/repression factor (e.g., zinc finger protein transcription factor, or ZFP TF. See, for example, the world wide web at sangamo.com/tech/tech_plat_over.html #whatarezfp). For example, a synthetic transcription facto sequence of a zinc finger DNA binding domain and a VP16 activation domain can be designed to bind to a specific endogenous DNA site and alter expression of an endogenous gene. An engineered transcription activation/repression factor (such as ZFP TF) can activate, repress, or switch the target endogenous biomass, sucrose, and/or conversion-gene expression by binding specifically to the promoter region or coding region of the endogenous gene. Engineered nucleases that cleave specific DNA sequences in vivo can also be valuable reagents for targeted mutagenesis. One such class of sequence-specific nucleases can be created by fusing transcription activator-like effectors (TALEs) to the catalytic domain of the FokI endonuclease. Both native and custom TALE-nuclease fusions direct DNA double-strand breaks to specific, targeted sites. Christian, et al., *Genetics* 186: 757-761 (2010).

In some embodiments, endogenous nucleic acids can be modified by mutagenesis. Genetic mutations can be introduced within regenerable plant tissue using one or more mutagenic agents. Suitable mutagenic agents include, for example, ethyl methane sulfonate (EMS), N-nitroso-N-ethylurea (ENU), methyl N-nitrosoguanidine (MNNG), ethidium bromide, diepoxybutane, ionizing radiation, x-rays, UV rays and other mutagens known in the art. Suitable types of mutations include, for example, insertions or deletions of nucleotides, and transitions or transversions in the endogenous nucleic acid sequence. In one embodiment, TILLING (Targeted Induced Local Lesions In Genomes) can be used to produce plants having a modified endogenous nucleic acid. TILLING combines high-density mutagenesis with high-throughput screening methods. See, for example, McCallum et al., *Nat Biotechnol* 18: 455-457 (2000); reviewed by Stemple, *Nat Rev Genet* 5(2):145-50 (2004).

In some embodiments, an endogenous nucleic acid can be modified via a gene silencing technique. See, for example, the section herein regarding "Inhibition of Expression of a Biomass composition-modulating Polypeptide."

A population of plants can be screened and/or selected for those members of the population that have a modified nucleic acid. A population of plants also can be screened and/or selected for those members of the population that have a trait or phenotype conferred by expression of the modified nucleic acid. As an alternative, a population of plants can be screened for those plants having a desired trait, such as a modulated level of biomass. For example, a population of progeny can be screened for those plants having a desired level of expression of a biomass composition-modulating polypeptide or nucleic acid. Physical and biochemical methods can be used to identify modified nucleic acids and/or expression levels as described with transgenic plants. Selection and/or screening can be carried out over one or more generations, and/or in more than one geographic location. In some cases, plants can be grown and selected under conditions which induce a desired phenotype or are otherwise necessary to produce a desired phenotype in a modified plant. In addition, selection and/or screening can be applied during a particular developmental stage in which the phenotype is expected to be exhibited by the plant. Selection and/or screening can be carried out to choose those modified plants having a statistically significant difference in biomass composition relative to a control plant in which the nucleic acid has not been modified. Selected or screened modified plants have an altered phenotype as compared to a corresponding control plant, as described in the "Transgenic Plant Phenotypes" section herein.

Although a plant or plant cell in which an endogenous biomass composition-modulating nucleic acid has been modified is not transgenic for that particular nucleic acid, it will be appreciated that such a plant or cell may contain transgenes. For example, a modified plant can contain a transgene for other traits, such as herbicide tolerance or insect resistance. As another example, a modified plant can contain one or more transgenes that, in conjunction with modifications of one or more endogenous nucleic acids, exhibits an increase in a component of biomass.

As with transgenic plant cells, modified plant cells can constitute part or all of a whole plant. Such plants can be grown in the same manner as described for transgenic plants and can be bred or propagated in the same manner as described for transgenic plants.

VI. Plant Breeding

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBR® Green), or a fluorophore-containing DNA probe, such as single-stranded oligonucleotides covalently bound to a fluorescent reporter or fluorophore (e.g. 6-carboxyfluorescein or tetrachlorofluorescein) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "*Arabidopsis* Protocols", pp. 137-146, J. M. Martinez-Zapater and J. Salinas, eds., c. 1998 by Humana Press, Totowa, NJ); Burr ("Mapping Genes with Recombinant Inbreds", pp. 249-254, in Freeling, M. and V. Walbot (Ed.), *The Maize Handbook*, c. 1994 by Springer-Verlag New York, Inc.: New York, NY, USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp) can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have a desired alteration in biomass composition. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VII. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such plants provide higher yields of ethanol, butanol, dimethyl ether, other biofuel molecules, and/or sugar-derived co-products per kilogram of plant material, relative to control plants. Such processing efficiencies are believed to be derived from the composition of the plant material, including, but not limited to, content of glucan, cellulose, hemicellulose, and lignin. By providing higher biomass yields at an equivalent or even decreased cost of production, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

VIII. Uses and Advantages

*Sorghum* plants described herein can be grown in large fields (e.g., 50 to 10,000 acre fields) to obtain harvestable biomass. For example, the *Sorghum* plants provided herein can be grown in fields of 100 acres or more at locations suitable for *Sorghum* growth such as southern United States, Brazil, and Mexico.

In one embodiment, the stalks of *Sorghum* plants described herein are harvested and processed, e.g., extracted using pressing and/or milling techniques, to obtain *Sorghum* stem juice. For example, the stalks can be harvested by hand or mechanical harvesters, and then crushed and pressed with a horizontal or vertical mill to extract the juice. One objective of the pressing and/or milling processes is to extract the largest possible amount of juice from the *Sorghum* biomass. Another objective is to produce bagasse with a low moisture content to be burned as a boiler fuel for electricity generation, thereby allowing a production plant to be self-sufficient in energy.

Sucrose, i.e., table sugar, can be produced from the juice using techniques including filtering, clarifying, decolorizing, and repeated concentration and crystallization. In some embodiments, table sugar is produced by blending sweet *Sorghum* juice with sugarcane juice prior to crystallization, thereby increasing the total yield of table sugar.

In other embodiments, the sugars in the juice can be fermented to produce a biofuel. For example, the juice can be filtered and used in a fermentation reaction to produce a biofuel. Examples of biofuels include, without limitation, biodiesel, methanol, ethanol, butanol, linear alkanes (C5-C20), branched-chain alkanes (C5-C26), mixed alkanes, linear alcohols (C1-C20), branched-chain alcohols (C1-C26), linear carboxylic acids (C2-C20), and branched-chain carboxylic acids (C2-C26). In some cases, the methods and materials provided herein can be used to make other chemical compounds such as ethers, esters, and amides of the aforementioned acids and alcohols, as well as other conjugates of these chemicals. In some cases, one or more of these compounds can be chemically converted into other high value and/or high volume chemicals.

Any appropriate microorganism can be used to produce biofuel in a fermentation reaction. For example, one or more microorganisms designed to produce ethanol can be used in fermentation reactions with *Sorghum* juice to produce ethanol-containing reaction products. In some cases, a microorganism useful for producing one or more biofuels as described herein is from a genus such as *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula*, and *Saccharomyces*. For example, ethanologenic yeast can be used in a fermentation reaction containing *Sorghum* juice to produce ethanol.

Any appropriate fermentation process can be used to produce biofuel using *Sorghum* juice. For example, batch, fed-batch, or continuous fermentation processes can be used to produce a biofuel using *Sorghum* juice. A batch fermentation process can include adding *Sorghum* juice substrate, fermentation organism(s) and culture medium at the beginning of the fermentation and not replenishing once fermentation has begun. In some cases, one or more culture parameters, e.g., pH and oxygen concentration, are monitored and adjusted during the fermentation process.

In some cases, a fed-batch fermentation process can be used to produce biofuel using *Sorghum* juice obtained from *Sorghum* plants provided herein. A fed-batch fermentation process is similar to a batch fermentation process except that substrate is added, and optionally culture medium nutrients, at intervals as fermentation progresses. In some cases, one or more culture parameters, e.g., pH, dissolved oxygen concentration, and/or carbon dioxide to oxygen ratio, are monitored and adjusted during the fermentation process. Fed-batch fermentation processes can allow users to control the amount of substrate within the fermentation reaction.

Continuous fermentation processes also can be used to produce biofuel using *Sorghum* juice obtained from *Sorghum* plants provided herein. A continuous fermentation process can be an open system in which a defined fermentation medium containing *Sorghum* juice material is continuously added to a bioreactor and an amount (e.g., an equal amount) of conditioned media is continuously removed for subsequent processing. Continuous fermentation can often be performed such that the fermentation organism is maintained at a high cell density and in a prolonged exponential growth phase, resulting in higher productivity than batch fermentation.

Examples of batch, fed-batch, and continuous fermentation processes that can be used to produce biofuel using *Sorghum* juice obtained from plants provided herein are described elsewhere (Thomas D. Brock in Biotechnology: A Textbook of Industrial Microbiology, Second Edition (1989) Sinauer Associates, Inc., Sunderland, Mass.; and Deshpande, Mukund V., *Appl. Biochem. Biotechnol.*, 36:227 (1992)).

Any appropriate fermentation media containing *Sorghum* juice can be used in a fermentation reaction to produce biofuel. In some cases, fermentation media used to produce biofuel as described herein can contain *Sorghum* juice as the primary carbon source (e.g., primary source of glucose, fructose, sucrose, mannose, or other sugars). In some cases, one or more other carbon sources can be used in combination with *Sorghum* juice provided herein to form fermentation media for producing biofuel. For example, *Sorghum* juice obtained from *Sorghum* plants provided herein can be combined with sugarcane juice (garapa) to form fermentation media for producing biofuel. In some cases, one or more other components such as minerals, salts, cofactors, and buffers can be included within fermentation media to promote culture growth and/or biofuel production. Examples of commercially available broths that can be used in combination with *Sorghum* juice material to create fermentation media include, without limitation, Luria Bertani (LB) broth, Sabouraud Dextrose (SD) broth, and Yeast medium (YM) broth.

Any appropriate culture conditions can be used to perform fermentation reactions designed to produce biofuel using *Sorghum* juice. For example, fermentation cultures can be grown or maintained at a temperature in the range of about 25° C. to about 40° C. and at a pH in the range of pH 5.0 to pH 9.0 (e.g., a pH in the range of 6.0 and 8.0, of 6.5 and 7.5, or 6.5 and 7.0). A fermentation reaction can be performed under aerobic, microaerobic, or anaerobic conditions.

In some cases, biofuel production can be monitored during a fermentation reaction or can be assessed when the fermentation reaction is completed. Any appropriate method can be used to assess biofuel production. For example, high performance liquid chromatography (HPLC) or gas chromatography (GC) can be used to measure biofuel production.

Once produced, biofuel can be isolated from the fermentation product. For example, techniques such as centrifugation, filtration, decantation, or combinations thereof can be performed to remove solids from the fermentation product. Once most or all of the solid material is removed, biofuel present within the remaining material can be isolated by, for example, techniques such as distillation, liquid-liquid extraction, dehydration, membrane-based separation, or combinations thereof. In some cases, molecular sieves, distillation techniques, azeotropic distillation techniques, centrifugation, vacuum distillation, or combinations thereof can be used to separate biofuel (e.g., ethanol) from water and/or fermentation byproducts. For example, water can be removed from an azeotropic ethanol/water mixture obtained from a fermentation reaction by azeotropic distillation to result in hydrous ethanol having about 95 to about 96.5 percent ethanol and about 3.5 to about 5 percent water. Azeotropic distillation can include adding benzene or cyclohexane to an ethanol/water mixture. When these components are added to the mixture, they can form a heterogeneous azeotropic mixture in vapor-liquid-liquid equilibrium. This can be distilled to produce anhydrous ethanol at the bottom of a column and a vapor mixture of water and cyclohexane/benzene. When condensed, the material can become a two-phase liquid mixture. In some cases, an extractive distillation process that involves adding a ternary component that increases the volatility of ethanol can be performed. Distillation of the ternary mixture can result in anhydrous ethanol on the top stream of a column.

In some cases, dehydration methods such as those involving molecular sieve techniques can be used to remove water from a biofuel. For example, ethanol vapor under pressure can be passed through a bed of molecular sieve beads. The pore size of the beads can be designed to allow absorption of water while excluding ethanol. After a period of time, the bed can be regenerated under vacuum or through the flow of inert gas (e.g., N2) to remove absorbed water. In some cases, two or more beds of beads can be used. In such cases, one can be used to absorb water, while the other one is undergoing regeneration. In some cases, the use of molecular sieve techniques can be performed in a manner that does not involve the use of distillation techniques.

In some cases, production of ethanol for biofuel involves denaturation of the ethanol. Ethanol can be denatured by, for example, combining it with natural gasoline, unleaded gasoline, or gasoline blend stocks. Corrosion inhibitors such as Ashland Amergy ECI-6 or Petrolite Tolad 3222 can be added to fuel ethanol if desired. Ethanol for fuel use can meet the specifications of ASTM D4806 (e.g., ASTM D4806-09). In some cases, the ethanol meets the specifications of ASTM D5453-93 for sulfur content, the specifications of ASTM D5580-95 for benzene or aromatic content, and/or the specifications of ASTM D6550-00 for olefin content. In some cases, ethanol for fuel use, produced as described herein, can meet Brazilian specification ANP #36 for hydrous ethanol or anhydrous ethanol.

In some cases, biomass remaining after extraction of juice (e.g., bagasse such as low moisture bagasse) or biomass not used for juice extraction can be used as a source of cellulosic material. Such cellulosic material can be used in fermentation reactions designed to metabolize cellulose and/or other *Sorghum* biomolecules in order to produce biofuel or can be used in combustion reactions designed to produce heat for use in energy production.

The invention will be further described in the following examples, which do not limit the scope of the invention described in the claims.

IX. EXAMPLES

Example 1

Procedures for Conversion Analysis

The conversion efficiency of control and transgenic switchgrass lines was determined indirectly using NIR composition and conversion models for switchgrass. See, WO2009/059176. Samples were prepared for analysis by drying the tissue samples for at least 3 days in an incubator set at 45° C. Dried tissues were milled using a Wiley Mill fitted with 20-mesh filter. Milled samples contained in a vial were scanned three times. The average scan was run through the NIR model and the predicted pretreatment liquid (PL) and saccharification (SAC) values were determined accordingly.

The yield of conversion was directly calculated as follows: [PLN value+SAC value]/amount of biomass weight, wherein "PLN" refers to pretreatment liquor neutralization, and "SAC" refers to the sugar value from the saccrification analysis. The following procedures were used to obtain the PLN and SAC values.

Microwave pretreatment: Milled tissues were weighed to obtain approximately 0.025 g. The moisture content of the weighed tissues was determined using the Denver Moisture Content analyzer. Tissues were transferred into separate Biotage microwave vials that were previously tared. Appropriate volume of sulfuric acid was then added into the samples to give a final concentration of 1.3%. Samples were pretreated in the microwave using the following settings: 165° C., 5 minutes, very high absorbance, 2.0-5.0 vial, 600 rpm stir speed (SWAVE default). The vials with the microwaved samples were centrifuged at 4000 rpm for 5 min with a deceleration rate set at ≤5. A minimum of 4 ml of PL from each vial was transferred into pre-labeled 15 ml Corning conical tubes. The pH of the PL fraction was measured. The PL was kept frozen until ready to analyze. The residue in each vial was washed several times by adding 5 ml water followed by centrifugation step at 4000 rpm for 5 min. The pH of the wash was monitored until it reached between 5 and 6 using appropriate pH indicator strips. The solid fraction was stored for saccharification analysis.

Pretreatment Liquor Analysis: To determine PLN (neutralized pretreatment liquor), calcium carbonate was added to an appropriate aliquot of each PL fraction until its pH reached between 5 and 6. The neutralized mixture was centrifuged at 4000 rpm for 2 min; after which 2 ml of the neutralized liquor was transferred to storage tubes.

To determine the sugar content, the neutralized fraction (PLN) was analyzed using a YSI Sugar Analyzer and/or by HPLC.

Saccharification Analysis: Water was added to the solid fraction obtained from the microwave pretreatment. Appropriate volume of enzyme mixture (containing appropriate weight of proprietary enzymes, tetracycline and cyclohexamide in citrate buffer) was added to the mixture followed by incubation at 50° C. in a rotating incubator. At the appropriate time period, an aliquot from the reaction was transferred to a microcentrifuge tube. The reaction was stopped by boiling the mixture for 5 min. The mixture was centrifuged for 2 min at 14,000 rpm. The supernatant was taken for sugar analysis using a YSI Sugar Analyzer and/or by HPLC. This sugar value represents the SAC value.

Example 2

Protocol for Sucrose Analysis

The sucrose content of control and transgenic switchgrass lines was determined indirectly using the NIR composition model for switchgrass. See WO2009/059176. Samples were prepared for analysis by drying the tissue samples for at least 3 days in an incubator set at 45° C. Dried tissues were milled using a Wiley Mill fitted with 20-mesh filter. Milled samples contained in a vial were scanned three times. The average scan was run through the NIR model and the predicted PL and SAC values were determined accordingly.

The sucrose content of selected samples was directly analyzed as follows. An appropriate amount of milled biomass (3-4 g) was placed into cell vial for extraction using the ASE200 extractor. Extraction was performed using water as solvent with the extractor set at following parameters: 1500 psi pressure, 100° C. temperature, no preheating, 5 min ramping, 7 min static step, and purging for 2 min. The volume of the collected extract was measured. Appropriate dilutions of the extracts were run through HPLC analysis to quantify the amount of sucrose using reference standards. The % sucrose content was calculated as follows: the amount of sucrose divided by the amount of biomass used in the extraction.

Example 3

Transgenic Switchgrass Lines

The following symbols are used in with respect to transformations: To: plant regenerated from transformed tissue culture; $T_1$: first generation progeny of self-pollinated $T_0$ plants; $T_2$: second generation progeny of self-pollinated $T_1$ plants; $T_3$: third generation progeny of self-pollinated $T_2$ plants.

The following nucleic acids were isolated from *Panicum virgatum* plants: CeresClone: 1807011 (SEQ ID NO:1); Ceres Clone 1955550 (SEQ ID NO:64); CeresClone: 240112 (SEQ ID NO:245); CeresClone: 1900192 (SEQ ID NO:279); CeresClone: 1776501 (SEQ ID NO:347); CeresClone: 1804732 (SEQ ID NO:415); CeresClone: 1955550 (SEQ ID NO:640); and CeresClone: 1789981 (SEQ ID NO:773).

Each isolated nucleic acid described above was cloned into T-DNA binary vectors, which were introduced into switchgrass (A26 or A10 clonally propagated lines) by *Agrobacterium*-mediated transformation essentially as described in Richards et al., *Plant Cell. Rep.* 20:48-54 (2001) and Somleva et al., *Crop Sci.* 42:2080-2087 (2002). At least two independent events from each transformation were selected for further study; these events were referred to as switchgrass screening lines. TO plants were grown in a greenhouse. The presence of each construct was confirmed by PCR.

Example 4

NIR Conversion Prediction for Transgenic Line PV00467

$T_0$ tissues from 22 events of PV00467 containing Ceres Clone 1955550 (SEQ ID NO:64) were analyzed as described in Example 1. Several non-transgenic wild-type plants that were regenerated at the same time as the transgenic plants were used as controls (also called batch wild-type control). The amount of glucose released after acid pretreatment (mg/g) of PV00467 lines is presented in Table 1. The average of the batch wild-type control plants (i.e., wt batch average) and the overall average of different wild-type controls from different batches (i.e., wt running average) are also presented in Table 1. The predicted glucose released in the pretreated liquor of some of the PV00467 transgenic events was higher as compared to the wild-type controls (either using the wt batch average value or the wt running average value).

TABLE 1

| Plant Line | PLN Glu Rel |
|---|---|
| PV00467-04 | 65.3 |
| PV00467-05 | 58.9 |
| PV00467-06 | 82 |
| PV00467-10 | 59.4 |
| PV00467-11 | 62.3 |
| PV00467-12 | 77.7 |
| PV00467-13 | 65.4 |
| PV00467-14 | 67.7 |
| PV00467-15 | 62.9 |
| PV00467-19 | 49.4 |
| PV00467-20 | 69.2 |
| PV00467-21 | 67.7 |
| PV00467-22 | 65.2 |
| PV00467-24 | 53.7 |
| PV00467-26 | 49.8 |
| PV00467-27 | 52.5 |
| PV00467-28 | 53.5 |
| PV00467-29 | 52.6 |
| PV00467-30 | 74.7 |
| PV00467-31 | 51.3 |
| PV00467-32 | 60.1 |
| PV00467-36 | 58.3 |
| WT (Batch) Ave | 55.18 |
| WT (Batch) SD | 4.90 |
| WT Running Ave | 58.33 |
| WT Running SD | 9.08 |

Example 5

NIR Conversion Prediction for Transgenic Line PV00508

T₀ tissues from 25 events of PV00508 containing Ceres Clone 1776501 (SEQ ID NO:347) were analyzed as described in Example 1. Several non-transgenic wild-type plants that were regenerated at the same time as the transgenic plants were used as controls (also called as batch wild-type control). The amount of glucose released after acid pretreatment (mg/g) of PV00508 lines is presented in Table 2. The average of the batch wild-type control plants (i.e., wt batch average) and the average of different wild-type controls from different batches (i.e., wt running average) are also presented in Table 2. The predicted glucose released in the pretreated liquor of some of the PV00508 transgenic events was higher as compared to the wild-type controls (either using the wt batch average value or the wt running average value).

TABLE 2

| Plant Line | PLN Glu Rel |
|---|---|
| PV00508-02 | 103.7 |
| PV00508-03 | 98.9 |
| PV00508-04 | 114.7 |
| PV00508-05 | 97.7 |
| PV00508-08 | 109.7 |
| PV00508-09 | 103.3 |
| PV00508-10 | 98.5 |
| PV00508-12 | 93.4 |
| PV00508-13 | 89 |
| PV00508-15 | 78.2 |
| PV00508-18 | 80.5 |
| PV00508-19 | 70.6 |
| PV00508-20 | 84.7 |
| PV00508-21 | 76 |
| PV00508-22 | 90.4 |
| PV00508-23 | 92.1 |
| PV00508-24 | 91.3 |
| PV00508-26 | 102.1 |
| PV00508-27 | 84.1 |
| PV00508-29 | 74.4 |
| PV00508-30 | 86.2 |
| PV00508-31 | 97.4 |
| PV00508-33 | 96.8 |
| PV00508-34 | 97.3 |
| PV00508-35 | 81.3 |
| WT (Batch) Ave | 77.05 |
| WT (Batch) SD | 12.77 |
| WT Running Ave | 58.33 |
| WT Running SD | 9.08 |

Example 6

Sucrose Content of Transgenic Lines UAC-20, UAC-22, and UAC-15

T₀ tissues from 5 events of UAC-20 containing Ceres Clone 1900192 (SEQ ID NO:279), 7 events of UAC-22 containing Ceres Clone 1807011 (SEQ ID NO:1), and 3 events of UAC-15 containing Ceres Clone 1804732 (SEQ ID NO:415) were analyzed as described in Example 2. Further analysis of the events of UAC-22 indicated that Ceres Clone 1807011 contains a deletion of a nucleotide at position 667 of SEQ ID NO:1, resulting in the production of a truncated protein. UAC-FA4 and UAC-NK4K were used as controls. UAC-FA4 is a wild-type plant regenerated from callus that was not transformed. UAC-NB4K corresponds to plants that were regenerated from callus transformed with an empty vector (i.e., with no insert). The average total sucrose content is presented in Table 3. All seven of the events of UAC-22 had an increased total sucrose content while three of the UAC-20 events and two of the UAC-15 events had an increased total sucrose content.

TABLE 3

| | Avg total % SUC StdDev | |
|---|---|---|
| | Avg total % SUC | StdDev |
| UAC-20-14 | 9.62 | 0.15 |
| UAC-20-15 | 2.55 | 0.12 |
| UAC-20-21 | 7.85 | 0.03 |
| UAC-20-5 | 11.56 | 0.10 |
| UAC-20-9 | 9.98 | 0.01 |
| UAC-22-10 | 10.67 | 0.41 |
| UAC-22-11 | 10.11 | 1.00 |
| UAC-22-14 | 7.91 | 0.30 |
| UAC-22-15 | 5.29 | 0.19 |
| UAC-22-17 | 11.73 | 0.63 |
| UAC-22-21 | 8.41 | 0.18 |
| UAC-22-26 | 9.98 | 0.26 |
| UAC-15-1 | 4.35 | 0.08 |
| UAC-15-3 | 9.66 | 1.00 |
| UAC-15-5 | 6.94 | 0.08 |
| UAC-FA4-12 | 1.13 | 0.04 |
| UAC-FA4-12 | 3.04 | 0.22 |
| UAC-NB4K-1 | 4.37 | 0.06 |
| UAC-NB4K-9 | 1.46 | 0.05 |

Example 7

NIR Conversion Prediction for Transgenic Lines UAC-15, UAC-19, and UAC-22

T₀ tissues from one event of UAC-15 containing Ceres Clone 1804732 (SEQ ID NO:415), one event of UAC-19 containing Ceres Clone 1789981 (SEQ ID NO:773), and one event of UAC-22 containing Ceres Clone 1807011 (SEQ ID NO:1) were each analyzed as described in Example 1. Further analysis of the events of UAC-22 indicated that Ceres Clone 1807011 contains a deletion of a nucleotide at position 667 of SEQ ID NO:1, resulting in the production of a truncated protein. UAC-FA4 and UAC-NK4K were used as controls and NREL SWG was used as a standard reference. UAC-FA4 is a wild-type plant regenerated from callus. UAC-NB4K corresponds to plants that were regenerated from callus transformed with an empty vector (i.e., with no insert). NREL SWG is a composite switchgrass biomass obtained from National Renewable Energy Laboratory (NREL) and was used as a method control to determine consistency of analytical techniques. The amount of total glucose released per gram dry weight, PLN, and SAC values are presented in Table 4 for four experiments in which different amount of enzymes were used in the saccharification analysis. Increased total glucose released per gram of dry weight was observed for each of the transgenic lines regardless of the enzyme amount. At standard level amount of enzymes (i.e., 20 mgP/g), the total glucose released by the transgenic lines UAC-15-6 and UAC-19-2 was higher than that of the controls and the reference standard. This increase was primarily due to the increase of glucose released during the pretreatment. When the amount of enzymes was reduced by 8-fold (i.e., 2.5 mgP/g), the total glucose released by the transgenic lines UAC-15-6 and UAC-19-2 was similar to the control treated at the standard enzyme level.

Example 8

NIR Conversion Prediction for Transgenic Line PV00460

T₀ tissues from three events of PV00460 containing Ceres Clone 240112 (SEQ ID NO:245) were analyzed as described in Example 1. Pv-WT(A26)-72 was the wild-type control used, which corresponds to a regenerated but untransformed plant. The amount of total glucose released per g dry weight, PLN, and SAC values are presented in Table 5 for four experiments in which different amount of enzymes were used in the saccharification analysis. Increased total glucose released per gram of dry weight was observed for each of the transgenic lines regardless of the enzyme amount. At standard level amount of enzymes (i.e., 20 mgP/g), the total glucose released by the transgenic lines PV00460 (especially event #18) was higher than that of the control. This increase was primarily due to the increase of glucose released during the pretreatment. When the amount of enzymes was reduced by 8-fold (i.e., 2.5 mgP/g), the total glucose released by the PV00460 transgenic line (for example event #18) was similar to the control treated at the standard enzyme level.

TABLE 4

| Type | Lines | Enzymes Amount | Total Glucose Released Per g dry weight | StdDev | PLN | StdDev | SAC | stdev |
|---|---|---|---|---|---|---|---|---|
| Control | NREL SWG | 20 mgP/g | 272.81 | 18.21 | 45.47 | 1.86 | 227.34 | 16.34 |
| Control | UAC-NB4K-1 | 20 mgP/g | 280.54 | 6.20 | 59.78 | 0.85 | 220.77 | 5.35 |
| Control | UAC-FA4-1 | 20 mgP/g | 328.69 | 23.57 | 118.38 | 3.69 | 210.30 | 19.88 |
| Transgenic Line | UAC-15-6 | 20 mgP/g | 332.16 | 11.11 | 158.01 | 4.79 | 174.15 | 6.32 |
| Transgenic Line | UAC-19-2 | 20 mgP/g | 322.05 | 7.47 | 124.06 | 3.36 | 198.00 | 10.82 |
| Transgenic Line | UAC-22-11 | 20 mgP/g | 336.61 | 12.68 | 113.24 | 1.67 | 223.37 | 14.34 |
| Control | NREL SWG | 5.0 mgP/g | 208.86 | 13.36 | 43.82 | 1.43 | 165.04 | 11.93 |
| Control | UAC-NB4K-1 | 5.0 mgP/g | 234.31 | 16.46 | 57.90 | 3.30 | 176.41 | 13.16 |
| Control | UAC-FA4-1 | 5.0 mgP/g | 263.34 | 4.04 | 111.18 | 1.07 | 152.16 | 5.11 |
| Transgenic Line | UAC-15-6 | 5.0 mgP/g | 293.04 | 12.46 | 154.26 | 6.15 | 138.78 | 6.32 |
| Transgenic Line | UAC-19-2 | 5.0 mgP/g | 276.58 | 15.36 | 117.96 | 4.86 | 158.61 | 10.51 |
| Transgenic Line | UAC-22-11 | 5.0 mgP/g | 287.47 | 13.08 | 115.32 | 0.17 | 172.16 | 12.91 |
| Control | NREL SWG | 2.5 mgP/g | 184.61 | 15.02 | 44.98 | 3.59 | 139.63 | 11.42 |
| Control | UAC-NB4K-1 | 2.5 mgP/g | 200.15 | 11.21 | 61.69 | 1.82 | 138.45 | 9.40 |
| Control | UAC-FA4-1 | 2.5 mgP/g | 222.18 | 6.37 | 114.04 | 0.67 | 108.14 | 7.03 |
| Transgenic Line | UAC-15-6 | 2.5 mgP/g | 268.36 | 8.95 | 155.02 | 3.25 | 113.33 | 5.70 |
| Transgenic Line | UAC-19-2 | 2.5 mgP/g | 239.20 | 22.92 | 121.76 | 4.39 | 117.44 | 18.53 |
| Transgenic Line | UAC-22-11 | 2.5 mgP/g | 247.62 | 21.78 | 115.54 | 3.83 | 132.09 | 17.95 |
| Control | NREL SWG | 1.0 mgP/g | 125.35 | 13.67 | 41.55 | 2.81 | 83.80 | 10.86 |
| Control | UAC-NB4K-1 | 1.0 mgP/g | 153.46 | 5.10 | 61.19 | 1.88 | 92.27 | 3.22 |
| Control | UAC-FA4-1 | 1.0 mgP/g | 184.70 | 2.55 | 119.55 | 2.57 | 65.15 | 0.02 |
| Transgenic Line | UAC-15-6 | 1.0 mgP/g | 243.99 | 1.27 | 164.69 | 2.24 | 79.30 | 0.97 |
| Transgenic Line | UAC-19-2 | 1.0 mgP/g | 203.52 | 0.86 | 120.25 | 4.05 | 83.27 | 4.90 |
| Transgenic Line | UAC-22-11 | 1.0 mgP/g | 202.32 | 2.31 | 115.67 | 4.54 | 86.65 | 6.85 |

TABLE 5

| Type | Lines | Enzymes Amount | Total Glucose Released Per g dry weight | StdDev | PLN | StdDev | SAC | StdDev |
|---|---|---|---|---|---|---|---|---|
| Control | NREL SWG | 20 mgP/g | 273.37 | 18.08 | 42.60 | 2.69 | 230.77 | 15.38 |
| Transgenic Line | PV00460-15 | 20 mgP/g | 333.23 | 11.09 | 99.60 | 2.55 | 233.62 | 8.54 |
| Transgenic Line | PV00460-18 | 20 mgP/g | 344.73 | 10.71 | 115.11 | 1.73 | 229.61 | 8.98 |
| Transgenic Line | PV00460-22 | 20 mgP/g | 323.11 | 13.52 | 88.89 | 0.05 | 234.22 | 13.57 |
| Control | Pv-WT (A26)-72 | 20 mgP/g | 282.99 | 10.83 | 53.96 | 0.99 | 229.03 | 9.84 |
| Control | NREL SWG | 5.0 mgP/g | 227.04 | 30.85 | 44.53 | 4.33 | 182.51 | 26.52 |
| Transgenic Line | PV00460-15 | 5.0 mgP/g | 310.22 | 10.57 | 103.72 | 0.89 | 206.50 | 11.46 |
| Transgenic Line | PV00460-18 | 5.0 mgP/g | 312.94 | 14.85 | 116.72 | 1.37 | 196.22 | 13.48 |
| Transgenic Line | PV00460-22 | 5.0 mgP/g | 287.63 | 11.73 | 89.26 | 0.04 | 198.38 | 11.69 |
| Control | Pv-WT (A26)-72 | 5.0 mgP/g | 243.22 | 4.08 | 52.16 | 1.54 | 191.06 | 2.54 |
| Control | NREL SWG | 2.5 mgP/g | 177.44 | 11.91 | 44.51 | 2.24 | 132.93 | 9.67 |
| Transgenic Line | PV00460-15 | 2.5 mgP/g | 268.84 | 6.50 | 104.91 | 0.10 | 163.94 | 6.41 |
| Transgenic Line | PV00460-18 | 2.5 mgP/g | 275.39 | 3.64 | 119.88 | 6.48 | 155.51 | 10.12 |
| Transgenic Line | PV00460-22 | 2.5 mgP/g | 250.62 | 8.11 | 89.65 | 1.49 | 160.97 | 6.62 |
| Control | Pv-WT (A26)-72 | 2.5 mgP/g | 220.13 | 1.31 | 52.16 | 1.41 | 167.97 | 2.71 |
| Control | NREL SWG | 1.0 mgP/g | 122.39 | 6.33 | 41.22 | 2.45 | 81.17 | 3.88 |
| Transgenic Line | PV00460-15 | 1.0 mgP/g | 207.42 | 9.99 | 106.12 | 2.86 | 101.30 | 7.13 |
| Transgenic Line | PV00460-18 | 1.0 mgP/g | 218.39 | 3.17 | 119.80 | 4.70 | 98.59 | 7.87 |
| Transgenic Line | PV00460-22 | 1.0 mgP/g | 196.32 | 1.90 | 93.97 | 1.09 | 102.35 | 2.99 |
| Control | Pv-WT (A26)-72 | 1.0 mgP/g | 141.59 | 5.82 | 51.56 | 0.52 | 90.03 | 6.34 |
| Control | NREL SWG | 0 mgP/g | 47.39 | 0.91 | 42.67 | 0.49 | 4.72 | 0.42 |
| Transgenic Line | PV00460-15 | 0 mgP/g | 107.20 | 0.32 | 104.09 | 0.70 | 3.11 | 0.39 |
| Transgenic Line | PV00460-18 | 0 mgP/g | 119.00 | 2.87 | 116.43 | 2.45 | 2.57 | 0.42 |
| Transgenic Line | PV00460-22 | 0 mgP/g | 94.54 | 1.21 | 91.87 | 1.64 | 2.67 | 0.43 |
| Control | Pv-WT (A26)-72 | 0 mgP/g | 57.74 | 0.11 | 54.62 | 0.07 | 3.12 | 0.18 |

Example 9

Transgenic *Sorghum* plants were made using the same construct containing Ceres Cone 1807011 (SEQ ID NO:1) as was used to make the transgenic switchgrass of Examples 3, 6, and 7. As described above, this results in the production of a truncated protein (e.g., about 142 residues in length). *Sorghum* stalk juice samples were harvested from four events containing Ceres Clone 1807011 and a control plant at approximately soft to hard dough stages. After harvesting, the Brix value of each juice sample was measured using a refractometer.

HPLC was carried out with the *Sorghum* juice stalk extracts. Samples were run on HPLC (Agilent 1100 series) to determine the sugar profile. A HPLC carbohydrate analysis column (Aminex® HPX-87P column) was used for the sugar analysis. The column was heated at 80° C. and the flow rate was set at 1 ml/min for analyzing extracts, respectively. Corona® CAD® detector (Thermo Scientific) was used to analyze the sugar samples. The data was analyzed using Agilent Chemstation software.

Table 6 presents the Brix and HPLC-determined sugar profiles from juice samples of transgenic and control plants. The data for each event were based on one juice sample for single plants. Each sample was divided to run in duplicate so the data represent an average of the duplicates for each sample. As shown in Table 6, all four transgenic events had an increased sucrose content, an increased total sugar content, and an increased Brix value compared to the control event. The sucrose content ranged from 48.18 to 75.85 mg/ml, with two of the events having a sucrose content of 62.23 to 75.85 mg/ml. The total sugar content ranged from 54.04 to 80.57 mg/ml, with three of the events having a total sugar content of 63.13 to 80.57 mg/ml. The Brix value ranged from 10.5 to 13.1%, with two of the events having a Brix value that ranged from 11.8 to 13.10%. Two of the transgenic events also had an increased glucose content compared to the control event.

TABLE 6

| Sample name | Suc (mg/ml) | Glc (mg/ml) | Frc (mg/ml) | Total sugars | Brix value (%) |
|---|---|---|---|---|---|
| Transgenic 204-02 | 54.54 | 5.19 | 3.4 | 63.13 | 10.5 |
| Transgenic 204-11 | 62.23 | 5.93 | 4.09 | 72.25 | 11.8 |
| Transgenic 204-25 | 48.18 | 3.66 | 2.2 | 54.04 | 11 |
| Transgenic 204-26 | 75.85 | 3.06 | 1.66 | 80.57 | 13.1 |
| 204-07 (pcr negative) | 13.78 | 3.26 | 2.22 | 19.26 | 6.6 |

Example 10

Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Missouri, USA was used to determine BLAST sequence identity and E-value. The BLASTP version 2.0 program includes the following parameters: 1) an E-value cutoff of 1.0 e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of 10-5 and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NOs: 483, 562, 246, 111, 348, 774, 416, 2, 157, 280, 641, and 26 are shown in FIGS. 1-12, respectively. Additional exemplary homologs are correlated to certain Figures in the Sequence Listing.

Example 11

Determination of Functional Homologs by Hidden Markov Models

Hidden Markov Models (HMMs) were generated by the program HMMER 2.3.2. To generate each HMM, the default HMMER 2.3.2 program parameters, configured for global alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO: 483.

The procedure above was repeated and an HMM was generated for each group of sequences shown in FIGS. 2-12, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (823 sequences)

SEQ ID NO: 1 - DNA, 2093 bp, Panicum virgatum
  misc_feature 1..2093: note = Ceres Clone ID no. 1807011
  misc_feature 1..2093: note = CeresClone_1807011_corrected DNA
  misc_feature 1..2093: note = Encodes the peptide sequence at SEQ ID NO. 2
  misc_feature 1..2093: note = Deletion of nucleotide at position 657 results in protein truncation
  source 1..2093: mol_type = other DNA
actaatctccgcggcgaaacgaattccttcccattccaatttccaccgctggaagaccaccacctgcgggcgccccaactccccacgttcccgagaggctccgatccgattcgcagcgcccgcccgccagccttctgccgccgcgtcccacgtgcgccccaccccgccgccagcgcagcgcttcgccctccgccctgtcgagccgcgatcccgtccggtccggggcgtcggatccggcggcgccctcgatgcggtcgccggggctcctggccgccgccctcgtcgcggcggcgctgctgctcgcggccggcgccggggcggccacggaggaggcctacgtcacgctgctgtacggcgacgagttcgtgctcggcgtgcgcgtcctgggcaagtccctccgcgacaccggcacgcggcgcgacatggtcgtgctcgtctccgacggcgtctccgagtactcgcggaagctcctccaggaagatggttggattgtgaatcgaataacattactggcaaatcctaatcaagtgaggccaaagaggttttggggtgtctacaccaagctaaagatatttaacatgacaagctacaaaaaagttgtttaccttgatgcagatactatcgttgtgaaaagtatcgaggatcttttcaagtgcgggaagttctgtggaaacttgaagcattctgaaagaatgaattctggagtaatggttgttgagccctctgaaactctattcaatgatatgatcgacaaagtgggtcgtttgccttcttacactggaggggaccaaggttttctaaattcatattatcctgactttcccaactcccgtgtctatgagccagactcacctttaactcctgaaccggaaacacagcgcctttctaccttgtataatgctgatgtgggtctttatatgctagccaacaagtggatggttgatgaaaaagaattaagagtcattcattacacgctgggtccccttaaaccctgggactggttcacagcttggcttgtaaaacctgttggaacatggcaggacattaggcaaaaacttgaagaatctctccctggaactggtggggggaggaacccacatgaccagctggttgtcaaaatattgttcattctcccattttgcctgctattatttggttattaccaatcgtgttttcagacaaacaaggagttgataagtataagatctctatgtgcatttgctagaagagcccgccacaaatacaagtctgaggagccattaccatcttattcagtggttggttcatcagctgcatttggtatttcaaaccaaaggttatcaaatgggacacattcgaagctccctccttattttgggccgatcgcagtgctagtttgctttatatctgctggcgtctcttttgcctttgcttttgctatcattccacggcaggttatgccatggacaggtttgctgctgatgtttgagttgacctttgtggcattcttcttattatttgggagttatcttcactttgtctatcaatggggaagtatgagtgcaaatcatgtgggatttaacaattctgattcatcagagaatcatattggatcaggccatcagcgcaatatgtccgactgtgatatggatgcaacattttactggataggaatggcggtcattgctactgttgctgtattgttaccaactatcttgggtataactgcattattcacaaagcttggattaatggttgctggcggtgttgtgctggcatcttttatgacatacgccgcagagcatcttgctatctcagccttcaacaagggtcagaaagacagaaatgcgagaactagaagcttttgtttttaacgacaagtaaattctgtacctacaccattgatccatgttgtattgtagtaggtttgtacacacagaaagaatgatggttccttttttttttgacacatggcttcctgcccagaccccctttttgtagcacgtcacgctgtcaactagtggtaaataggttcccagatgttgtttatttatgcggcacggttggctcgcacagtaaatcttgtcaatagagcagtcactgccatttgcttg

SEQ ID NO: 2 - protein, 534 aa, Panicum virgatum
  REGION 1..534: note = Ceres Clone ID no. 1807011
  REGION 1..534: note = Ceres Seed Line no. UAC-22
  REGION 30..253: note = Pfam Name: Glyco_transf_8 Pfam Description: Glycosyl transferase family 8,
  REGION 1..534: note = Bit score of 1419.1 for HMM based on sequences of Figure 8
  REGION 1..534: note = Figure 8
MRSPGLLAAALVAAALLLAAGAGAATEEAYVTLLYGDEFVLGVRVLGKSLRDTGTRRDMVVLVSDGVSEYSRKLLQEDGWIVNRITLLANPNQVRPKRFWGVYTKLKIFNMTSYKKVVYLDADTIVVKSIEDLFKCGKFCGNLKHSERMNSGVMVVEPSETLFNDMIDKVGRLPSYTGGDQGFLNSYYPDFPNSRVYEPDSPLTPEPETQRLSTLYNADVGLYMLANKWMVDEKELRVIHYTLGPLKPWDWFTAWLVKPVGTWQDIRQKLEESLPGTGGGRNPHDQLVVKILFILPFCLLLFGYYQSCFQTNKELISIRSLCAFARRARHKYKSEEPLPSYSVVGSSAAFGISNQRLSNGTHSKLPPYFGPIAVLVCFISAGVSFAFAFAIIPRQVMPWTGLLLMFELTFVAFFLLFGSYLHFVYQWGSMSANHVGFNNSDSSENHIGSGHQRNMSDCDMDATFYWIGMAVIATVAVLLPTILGITALFTKLGLMVAGGVVLASFMTYAAEHLAISAFNKGQKDRNARTRSFCF

SEQ ID NO: 3 - DNA, 1611 bp, Sorghum bicolor
  misc_feature 1..1611: note = Ceres Annot ID no. 8701928
  misc_feature 1..1611: note = Encodes the peptide sequence at SEQ ID NO. 4
  source 1..1611: mol_type = other DNA
atgcggtcgccggcgctcctggccgccgccctagtcgcggcggtgctcctcgctgccggtgccggggtcgcggcggccgcgacggaggaggcctacgtcacgctgctgtacggcgacgagttcgtgctcggcgtgcgcgtcctgggcaagtccctccgcgacaccggcacgcggcgcgacatggtcgtgctcgtctccgacggcgtctccgagtactcgaggaagctcctccaggcagatggttggattgtgaatcgtataacattactggctaatccgaaccaagttagaccaaagagattttggggtgtctacaccaagctaaagatatttaacatgacaaactacaaaaaagttgtttaccttgatgcagatactatagttgtgaaaagtatcgaggatcttttcaagtgtggcaagttttgtggaaacctgaagcattctgaaagaatgaattctggtgtgatggttgttgaaccctctgaaactcttttcaatgatatgatcaacaaagtgggtcaattgccttcttacactggtggggaccaaggttttctaaattcatattattctgattttgccaactcccgtgtctatgagccagactcgcctttaactcctgaaccggagacacaacgcctttctaccttgtataatgctgatgttggtctttacatgctagcaaacaagtggatggttgatgagaaggaattaagaatcatccattacacgctgggtcccctaaaaccctgggactggttcacagcgtggcttgtaaaacctgttgaaacatggcaggatattaggcaaaaacttgaagaatctcttccaggaactggtgggggaaggaaccctcatgaccagctggttgtcaaaatattgttcattctcccattttgcttgctgttatttggttattaccaatcatgttttcagacaaacaaggagttgataagtataagatcactatgtgcatttgctagaagagctcgccacaaatacaagtctgaagagtcacttccatcttattcagtggtgggttcatcgtctgtatttggtatttcaaaccaaaggttatcaaatggacatttgaagctaccttcttattttggggtaatcgcggtgctagtctgcttcatgtctgctggtttctctctcgcatttgctttcattatcattccacggcaggttatgccatggacaggtttgctactgatgcttgagtggacctttgtggcattcttcttattgtttgggagttatctccgttttgtctaccggtggggaagtattagtgcaaaccatgtgggctttagcaattccgatgcatcagagaatcatatgggtccaggccatcagcgaaatatgtctgactgcgacatggatgcaacattttactggatagggatggcaactatagctactattactgtattgttaccaactatcttgggcataactgcactgttcacaaagctaggattaatggtcgctggtggtattgtgctggcatcttttatgacatacgcagcggagcatcttgcaatctcagccttcaacaagggtcagaaagacagaaatgcgtcaagaactcgaagcttttgtttttaa

SEQ ID NO: 4 - protein, 536 aa, Sorghum bicolor
  REGION 1..536: note = Ceres Annot ID no. 8701928
  REGION 32..255: note = Pfam Name: Glyco_transf_8 Pfam Description: Glycosyl transferase family 8
  REGION 1..536: note = Bit score of 1431.1 for HMM based on sequences of Figure 8
  REGION 1..536: note = Functional Homolog Of SEQ ID NO. 2
  REGION 1..536: note = Figure 8
MRSPALLAAALVAAVLLAAGAGVAAAATEEAYVTLLYGDEFVLGVRVLGKSLRDTGTRRDMVVLVSDGVSEYSRKLLQADGWIVNRITLLANPNQVRPKRFWGVYTKLKIFNMTNYKKVVYLDADTIVVKSIEDLFKCGKFCGNLKHSERMNSGVMVVEPSETLFNDMINKVGQLPSYTGGDQGFLNSYYSDFANSRVYEPDSPLTPEPETQRLSTLYNADVGLYMLANKWMVDEKELRIIHYTLGPLKPWDWFTAWLVKPVETWQDIRQKLEESLPGTGGGRNPHDQLVVKILFILPFCLLLFGYYQSCFQTNKELISIRSLCAFARRARHKYKSEESLPSYSVVGSSSVFGISNQRLSNGHLKLPSYFGVIAVLVCFMSAGFSLAFAFIIIPRQVMPWTGLLLMLEWTFVAFFLLFGSYLRFVYRWGSISANHVGFSNSDASENHMGPGHQRNMSDCDMDATFYWIGMATIATITVLLPTILGITALFTKLGLMVAGGIVLASFMTYAAEHLAISAFNKGQKDRNASRTRSFCF

SEQ ID NO: 5 - DNA, 1979 bp, Triticum aestivum
  misc_feature 1..1979: note = Ceres Clone ID no. 630287
  misc_feature 1..1979: note = Encodes the peptide sequence at SEQ ID NO. 6
  source 1..1979: mol_type = other DNA
atgagaagatcaccatagcactggacaacctcccgatcccgagcagctccgattggaaggccgccgtggcgagatcccgcgcgggcagggcctcgatgggaccaccgccgaccaggtggcccctgctggccgccctcgtcgcggcggcgctgctcgccggcgcggcggcggcgacggaggaggcctacgtcacgctgctctacggcgacgagttcgtcctcggcgtgcgcgtcctgggcaagtccatccgcgacaccggcacgcggcgggacatggtcgtgctcgtctccgacggcgtctccgagtactcgcgggagctcctcgaggctgatggttggatcgtgaagcgtataactttactggctaatcctaaccaagtgagaccaacgaggttttggggtgtctacacaaagttgaagatattcaacatgacaagctacaaaaaggttgtttatcttgatgcagatactgtagttgtaaaaagtatcgaggatgttttcaagtgtaggaagttctgtgggaacttgaagcattctgaaagaatgaattccggagtgatggttgtggagccatctgaaactgttttcaaggatatgattagccaagtagaccggttgccttcctacactggaggggatcaaggttttcttaattcatattatgctgattttgctaactcccgcgtgtatgagccagactcacctttaacacctgaaccggagacacagcgcctttctaccttgtataatgctgatgttggtctttacatgctagccaacaagtggatggttgatgaaaaggaacttagagttattcactacacactaggtccccttaaaccctgggactggtggacagcttggcttgtaaaacctgtggagatatggcaggatgttaggcaaaaacttgaagaatctcttccgggaaccggtgggggaaggaaccctcatgatcagctggtggtcaaatttttattcattcttcccttctgcctgctgttatttggttattaccaatcatgctttcagaactataaggattttccaagtgtgcagtctttatgtgcgtttgcaagaagaggccgtcataagtataagtctgaagaggcacttccatcttattcagcagttggtgtttcatcatctacattttctacttcaaatcaaagaatctcaaacgggccacatctgaagctgccttcttatttcggggcgattgctgtgctaatctgttttatgtctgctggtgtctctcttgcctttgctttcactatcattccacgacaaattatgccatggacaggtctgctactgatgtttgagtggaccttcgtggcattcttcttattgtttggtagctatctccgttttgtctatcgatggggaagtatcagtgcaactcatgtgggatatagcaattctgattcatcagagaatcacatggctacaggccatcatcagcgcaatatatctgacttcgacatggaggcgacattttactggacagggatggctgtcatagctatcattactgtattttcaccaactatcttgggtataactgcattatttacaaagctagggttgatggttgccggtggtgttctgctggcatcttttatgacgtatgcttcggtgcatcttgctatctcagccttccacaagggtcaaaaagataggaatgggtcgagaactagaagaatttgtttctggtgtttgtagtaagctttgtgcctgcattgttaatttagttcatgttgttgtacatttttactcaaggaaattttggtggttccgttggcacagatattccacttttgtaacactgatgccaaatcaaaggtacataggttccaatagttgacatgcagctcgcaggcctgcaagtgtaaagctttttgtctataaaactcttcctgccatttgctcgttgtacaatatgatcggcggttctatattggaactatggaacatgaactc

SEQ ID NO: 6 - protein, 541 aa, Triticum aestivum
  REGION 1..541: note = Ceres Clone ID no. 630287
  REGION 31..254: note = Pfam Name: Glyco_transf_8 Pfam Description: Glycosyl transferase family 8
  REGION 1..541: note = Bit score of 1416.1 for HMM based on sequences of Figure 8
  REGION 1..541: note = Functional Homolog Of SEQ ID NO. 2
  REGION 1..541: note = Figure 8
MGPPPTRWPLLAALVAAALLAGAAAATEEAYVTLLYGDEFVLGVRVLGKSIRDTGTRRDMVVLVSDGVSEYSRELLEADGWIVKRITLLANPNQVRPTRFWGVYTKLKIFNMTSYKKVVYLDADTVVVKSIEDVFKCRKFCGNLKHSERMNSGVMVVEPSETVFKDMISQVDRLPSYTGGDQGFLNSYYADFANSRVYEPDSPLTPEPETQRLSTLYNADVGLYMLANKWMVDEKELRVIHYTLGPLKPWDWWTAWLVKPVEIWQDVRQKLEESLPGTGGGRNPHDQLVVKFLFILPFCLLLFGYYQSCFQNYKDFPSVQSLCAFARRGRHKYKSEEALPSYSAVGVSSSTFSTSNQRISNGPHLKLPSYFGAIAVLICFMSAGVSLAFAFTIIPRQIMPWTGLLLMFEWTFVAFFLLFGSYLRFVYRWGSISATHVGYSNSDSSENHMATGHHQRNISDFDMEATFYWTGMAVIAIITVFSPTILGITALFTKLGLMVAGGVLLASFMTYASVHLAISAFHKGQKDRNGSRTRRICFWCL

SEQ ID NO: 7 - protein, 547 aa, Oryza sativa
  REGION 1..547: note = Public GI ID no. 115447391
  REGION 40..263: note = Pfam Name: Glyco_transf_8 Pfam Description: Glycosyl transferase family 8
  REGION 1..547: note = Bit score of 1412.2 for HMM based on sequences of Figure 8
  REGION 1..547: note = Functional Homolog Of SEQ ID NO. 2
  REGION 1..547: note = Figure 8
  source 1..547: note = Oryza sativa subsp. japonica
MWRRRGAPSGIGLWAALLVAAAVLAAGGGAAAAAAKDEAYVTLLYGDEFVLGVRVLGKSIRDTDTSRDLVVLVSDGVSEYSRKLLEADGFIVKHITLLANPNQVRPTRFWGVYTKLKIFNMTSYKKVAYLDADTIVVKSIEDIFNCGKFCANLKHSERMNSGVMVVEPSETLFNDMMDKVNSLPSYTGGDQGFLNSYYADFANSRVYEPNKPTTPEPETQRLSTLYNADVGLYMLANKWMVDEKELRVIHYTLGPLKPWDWWTAWLVKPVAVWQDIRKNLEESLPGTGGGRNPHDQSVVKILFSLPLFMLICGYYGSCFQTNKELLCIRSLCAFARRARYKYKSEEALPSYSTIGAASSSFGISHQKSHNGAHLKLPSYFGAITVLVCFISALISLAFAFIIIPRQVMPWTGLLLMYEWTSVTFFLLFGSYLRVVYNWGSSSANHVGHNNLDSSENHAGAGLQRNTSDCDTDAAFYWSGMAILSSIALLSPTVLGITALFAKLGLMVAGGVVLASFMTYASEHLAISAFVKGQRDRNASRGSICFMC

SEQ ID NO: 8 - protein, 546 aa, Vitis vinifera
  REGION 1..546: note = Public GI ID no. 225453032
  REGION 32..260: note = Pfam Name: Glyco_transf_8 Pfam Description: Glycosyl transferase family 8
  REGION 1..546: note = Bit score of 1441.8 for HMM based on sequences of Figure 8
  REGION 1..546: note = Functional Homolog Of SEQ ID NO. 2
  REGION 1..546: note = Figure 8
MKSRLFNFWFLLILLAWIRSPSPVRASGSEAYVTLLYGDEFLLGVRVLGKSIRDTGSTKDMVVLVSDGVSDYAKKLLQADGWIVELISLLANPNQVRPKRFWGVYTKLKIFNMTNYKKVVYLDADTIVVKSIEDLFKCGKFCANLKHSERLNSGVMVVEPSETVFNDMMSKVKTLPSYTGGDQGFLNSYYTGFASAHVFDPDLSPEERNARPVPKMERLSTLYNADVGLYMLANKWMVDEEKLRVIHYTLGPLKPWDWWTSWLLKPVDVWQNVREQLEGSLPGTEGGRNPNDTILVKFLFLIPLLALLFCYYRSFLQTREFFGSFCRTTLCDPLRHLYYKFRSGGALPYSSVSSSSTINSNQQFSNGAQSKVPVYLGGISVVICFMVAVVSLALALSVVPRQVMPWTGLLLMYEWAFTSFFLLFGGYLHLIYQWGKMTASQAGSFASRPVSADYDSGKGHQRQVSSCDAATWYYGLGMAFLAVAAPSLPCVFGVTALFLRLGLIAVGALILASFMTYAAEHLAIRSFVKGLEDRDTPRSRSVCFLC

SEQ ID NO: 9 - DNA, 1967 bp, Gossypium hirsutum
  misc_feature 1..1967: note = Ceres Clone ID no. 1919301
  misc_feature 1..1967: note = Encodes the peptide sequence at SEQ ID NO. 10
  source 1..1967: mol_type = other DNA
tcttcaaagctcctcgtgtttatcaacctttaattcaatcctgaagggaaaaaaaattcaaataaacaaagtaattttatcctcgaggaaatccggatcattttctcgagaaaatcgaatactatgaaactaccaaaactctcgatcctgtttctgctccttttgattattatacaaacaaaggcggcgttgggggctaaagctcaatcttcatcgaaagaagcttatgtgacgctgctgtacggagatgagttcctcttaggggttagggttttagggaaatcgataagggacactggatcaactagagacatggtcgttttggtctctgatggcgtctctgattatgctaaaaagcttctaaaggctgatggatggatggtggagatgataagcttattggcaaatccgaatcaagttcggccgaagagattttggggtgtttacaccaaattgaaaatttttaatatgactaactacaagaaagttgtgtatcttgatgcggatactatagtagtcaagagcattgaagatctctttaaatgtcagaaattttgtgcaaatttgaagcattctgagaggttgaattcaggagtcatggtagtggaaccatctgaagctgttttcaatgacatgatgagcaaagtcaatactttgccttcttatactggaggagatcagggttttctgaattcttactactctgatttctcaaatgcacatgtttttgaccctaatatacccgaggaggtgctgaaatcccgtcctgctcctgagatggaacgactttctactctatacaatgcagatgttggtctttacatgcttgccaacaagtggatggtagatgagagtgaacttcgtgtaattcactatacacttggcccccttaaaccttgggattggtggacatcttggctcttgaaaccagtcgatgtctggcagaatgttagggaacagcttaaagagtcccttcctggaactgggggaggcaaaaatccaaatgatgagcttctaatcaaattccttttcctcttacctttctgtgctttacttttttgtttctatcgttctttcgttcagacagggggttcagtttgcagaacttcattatgcaatcaggtcagacacttctaccacataattaggtcgagtgggacagttgcttacactagtgtttcttcatcttctaccattaacgcaaacagtcagtttcctaacagtgcacagaacaaggtgcctgcatacttgggtgcaatttcagttttcgtatgctttatggctgctgtggtgtcccttggaatttctatttcaattgtgcctcgacaagtgatgccatggactggtttgctcttgatgtatgagtggacgttttcaatcttctttctttcattcggagcatttcttcatttgatttatctgtggggaaaaagagaaccagggccagtttcctctcgtatggatcctattgattcggattctagaaaaggttatcgacaggcatcctcttgcgatattgttacttggtattatggattggggatggcttttttggctatcgcagccccatccttaccatgtatttttgggatcaccgctctgttcatgaggttgggtctgatggtcgttggagggcttatattagcggcattcatgacatatgcttcggaacatctagcgattaggtcattcttgaaaggtcttgaagaccggaacaccactcggtcgaggagtgcatgtttcttatgttgaaagaaaacttccaaaatgatcatgacacttaccagcactgcatttttccttcaaatttgtgttctatttaacatttaatcacaacagttgatctgtaaaatattgcagtcaattttggctaattagaaatgtatttttttttccattaggcgtctttttgctactttgttgtgaaaaatactcagtttcccatataataccaccataattcacat

SEQ ID NO: 10 - protein, 542 aa, Gossypium hirsutum
  REGION 1..542: note = Ceres Clone ID no. 1919301
  REGION 35..263: note = Pfam Name: Glyco_transf_8 Pfam Description: Glycosyl transferase family 8
  REGION 1..542: note = Bit score of 1435.0 for HMM based on sequences of Figure 8
  REGION 1..542: note = Functional Homolog Of SEQ ID NO. 2
  REGION 1..542: note = Figure 8
MKLPKLSILFLLLLIIIQTKAALGAKAQSSSKEAYVTLLYGDEFLLGVRVLGKSIRDTGSTRDMVVLVSDGVSDYAKKLLKADGWMVEMISLLANPNQVRPKRFWGVYTKLKIFNMTNYKKVVYLDADTIVVKSIEDLFKCQKFCANLKHSERLNSGVMVVEPSEAVFNDMMSKVNTLPSYTGGDQGFLNSYYSDFSNAHVFDPNIPEEVLKSRPAPEMERLSTLYNADVGLYMLANKWMVDESELRVIHYTLGPLKPWDWWTSWLLKPVDVWQNVREQLKESLPGTGGGKNPNDELLIKFLFLLPFCALLFCFYRSFVQTGGSVCRTSLCNQVRHFYHIIRSSGTVAYTSVSSSSTINANSQFPNSAQNKVPAYLGAISVFVCFMAAVVSLGISISIVPRQVMPWTGLLLMYEWTFSIFFLSFGAFLHLIYLWGKREPGPVSSRMDPIDSDSRKGYRQASSCDIVTWYYGLGMAFLAIAAPSLPCIFGITALFMRLGLMVVGGLILAAFMTYASEHLAIRSFLKGLEDRNTTRSRSACFLC

SEQ ID NO: 11 - DNA, 1806 bp, Arabidopsis thaliana
  misc_feature 1..1806: note = Ceres Annot ID no. 883070
  misc_feature 1..1806: note = Encodes the peptide sequence at SEQ ID NO. 12
  source 1..1806: mol_type = other DNA
aaacaacgaagaaaattcaaaatcttatttcaattcaacgtatactttccttaaattaggaatttggttttcgagaaaattgagatccgaataactatggtgagactcaagacgagtctctgggttcttctccttgccctcgtttcaattcagttaaatggttcgtttggatctgaatcaagtaaagtagcttatgtcacacttttgtatggagatgagttcttattaggagttagggtattgggtaaatcgattcgtgacactggatccactaaggatatggtcgctttggtttctgatggtgtctcagactactctaagaagttactcaaggctgatggatggaaagtagagaagattagtttactggcaaatccaaatcaagttcatccgactaggttctggggtgtttatacaaagcttaagatctttaacatgactgattataagaaagttgtgtatcttgatgctgatactattgtggtaaagaacattgaggatctgtttaagtgttctaagttttgcgcaaacttgaagcattctgagaggctaaactctggtgtgatggttgttgaaccatctgaagctctttttaatgacatgatgcggaaagtgaagactttgtcttcttatactggaggagatcaagggttcttgaattcgtattatccggatttcccgaatgctcgtgttttcgatcctagtgtaactcctgaagtcttgaaaaccagaccagttcctgctatggagaggctttcgacattatacaatgcggatgttggtctttatatgcttgctaataagtggatggttgatgacagtaaacttcacgtcattcactacactctaggccctcttaagccttgggactggtggacagcatggctcgtgaaacctgttgatgcttggcatagcattagggtaaagcttgaggaaactcttcctggaactggaggtggtagtaaccaacatgatgaactcgtcgtcaagttccttttcttgttacctctttgtgcacttttgttctgcatttaccgatccattcagggccgtgagggttcattgtgctggagctcgttcagcaatcagattagatatctttattacaaagttagatctaatggaacacttggttatggcggtgtatctaccatgagtcccagctatcaaccccacagtggcaacgcacagtccaaggttcctcaacacttaggcgcagtttcagttgtcgtctgttttactgctgttctgttatctcttggaatttcctttgcgattgtgcctaggcaaatcatgccatggactggcttggtcttggtgtatgaatggacttttacaatcttctttcttttgtttggtgtcttcttgctttttgtgcatcaacatggaaagagaatagcgatacaatcagaatcatcttccttggatgattccgcaaaagttcatcagcgagcaggtgggtcttgtgacgttactacattgtattatggattagggatggcttttctggctattgctgcagtttctttaccttacattttggggatcactgctttattcacgaggttgggtctaatggtgggtctagccataattctagctgccttcatgacttatgcttcagagcacctcgcggtgagatggttcttgaaaggtctagaagaccgtcgtgacacgacgagatcaaattccctatgtttcctctgttgacaacaaaatatgtaaaagtgtcaccaatcaccattgtaactttcagaaacaacagagcctataattctgtcttgaaatggttacacctttgttctt

SEQ ID NO: 12 - protein, 537 aa, Arabidopsis thaliana
  REGION 1..537: note = Ceres Annot ID no. 883070
  REGION 33..261: note = Pfam Name: Glyco_transf_8 Pfam Description: Glycosyl transferase family 8
  REGION 1..537: note = Bit score of 1386.8 for HMM based on sequences of Figure 8
  REGION 1..537: note = Functional Homolog Of SEQ ID NO. 2
  REGION 1..537: note = Figure 8
MVRLKTSLWVLLLALVSIQLNGSFGSESSKVAYVTLLYGDEFLLGVRVLGKSIRDTGSTKDMVALVSDGVSDYSKKLLKADGWKVEKISLLANPNQVHPTRFWGVYTKLKIFNMTDYKKVVYLDADTIVVKNIEDLFKCSKFCANLKHSERLNSGVMVVEPSEALFNDMMRKVKTLSSYTGGDQGFLNSYYPDFPNARVFDPSVTPEVLKTRPVPAMERLSTLYNADVGLYMLANKWMVDDSKLHVIHYTLGPLKPWDWWTAWLVKPVDAWHSIRVKLEETLPGTGGGSNQHDELVVKFLFLLPLCALLFCIYRSIQGREGSLCWSSFSNQIRYLYYKVRSNGTLGYGGVSTMSPSYQPHSGNAQSKVPQHLGAVSVVVCFTAVLLSLGISFAIVPRQIMPWTGLVLVYEWTFTIFFLLFGVFLLFVHQHGKRIAIQSESSSLDDSAKVHQRAGGSCDVTTLYYGLGMAFLAIAAVSLPYILGITALFTRLGLMVGLAIILAAFMTYASEHLAVRWFLKGLEDRRDTTRSNSLCFLC

SEQ ID NO: 13 - DNA, 1500 bp, Populus balsamifera
  misc_feature 1..1500: note = Ceres Annot ID no. 1469624
  misc_feature 1..1500: note = Encodes the peptide sequence at SEQ ID NO. 14
  source 1..1500: mol_type = other DNA
atgacgcgaactgtattgcaggctaacctgactcaaatccgctatacatgtctcgctgcttcgattcagagatcgcagagaacagaggaggcttacgttacgttgttatacggagatgagtttttattgggagttagggttttggggaaatcaattagagatactggatccaccaaagatattgtcgttttagtctctgatggtgtctctgattatgccaagaagcttttactggctgatgggtggatagtggagaaaatcagcttattggcgaatcctaatcaagttcggccgaagaggttttggggtgtatatactaaactaaaaatctttaacatgactaactacaaaaaagttgtatatcttgatgcggatactattgtggtcaaaagcattgaggatcttttcaagtgtgcgaaattctgtgccaatctgaagcattcagaaaggttaaattcaggagtcatggtggtggaaccatctgaaacagttttcaataacatgatgagcaaagtaaccactttgccctcttacacgggaggagatcaggggtttctcaactcctattatgaagaatttccaaatgcacatgttttccaacctggtttacctgaggaagtacggaaaagtagacctgtacctgatatggagcggctctctactttatataatgcagatgttggtctttacatgcttgctaacaagtggatggtagatgagaatgaactccgtgttattcactatacacttgggcccctcaaaccttgggactggtggacatcttggcttttaaaacctgttgatgtctggcagagagtcagggaacagcttgatgagtcccttcctggaactggaggtggaaaaaatccaaaagatgaacttcttgtcaaagttcttttcttgttaccattatgtcttgtacttctctgttactaccgctcttttcttcagttctccaatgacgcacagtccaaggtgccagcgtatttgggtggagtttccatcttcatgtgttttatggctcttttgatcgccctcgggtttggtctttcaattgtgcctcggcaagtgatgccctggactggtttgctcttgatgtatgagtggacattcacaatcttcttccttttatttggaggctttctccacttgatctatatatggggaaagaggatggcaactcaagctgcatcactttctcctcattctgaatctttggcatatgattctagaaaaggtcatcggcaggggtcaacttgcgatgttgctgcatggtactatggtttagggatggctttgttggctgttggtgccccttcattaccttgtatttttggtgttactgctctatttttgaggttagggttgatggttgctggaggcctggttttagcatctttcatgacgtatgcttcagaacatcttgcaatcagatcatttttgaaaggctttgaagaccgggacacagcacgagctaggaacgaatgtttcttattttga

SEQ ID NO: 14 - protein, 499 aa, Populus trichocarpa
  REGION 1..499: note = Ceres Annot ID no. 1469624
  REGION 32..260: note = Pfam Name: Glyco_transf_8 Pfam Description: Glycosyl transferase family 8
  REGION 1..499: note = Bit score of 1308.7 for HMM based on sequences of Figure 8
  REGION 1..499: note = Functional Homolog Of SEQ ID NO. 2
  REGION 1..499: note = Figure 8
MTRTVLQANLTQIRYTCLAASIQRSQRTEEAYVTLLYGDEFLLGVRVLGKSIRDTGSTKDIVVLVSDGVSDYAKKLLLADGWIVEKISLLANPNQVRPKRFWGVYTKLKIFNMTNYKKVVYLDADTIVVKSIEDLFKCAKFCANLKHSERLNSGVMVVEPSETVFNNMMSKVTTLPSYTGGDQGFLNSYYEEFPNAHVFQPGLPEEVRKSRPVPDMERLSTLYNADVGLYMLANKWMVDENELRVIHYTLGPLKPWDWWTSWLLKPVDVWQRVREQLDESLPGTGGGKNPKDELLVKVLFLLPLCLVLLCYYRSFLQFSNDAQSKVPAYLGGVSIFMCFMALLIALGFGLSIVPRQVMPWTGLLLMYEWTFTIFFLLFGGFLHLIYIWGKRMATQAASLSPHSESLAYDSRKGHRQGSTCDVAAWYYGLGMALLAVGAPSLPCIFGVTALFLRLGLMVAGGLVLASFMTYASEHLAIRSFLKGFEDRDTARARNECFLF

SEQ ID NO: 15 - protein, 560 aa, Physcomitrella patens
  REGION 1..560: note = Public GI ID no. 168065791
  REGION 54..279: note = Pfam Name: Glyco_transf_8 Pfam Description: Glycosyl transferase family 8
  REGION 1..560: note = Bit score of 1291.0 for HMM based on sequences of Figure 8
  REGION 1..560: note = Functional Homolog Of SEQ ID NO. 2
  REGION 1..560: note = Figure 8
MFRGRLVLVLFLVVIFSNVFVSSAGSSSRSFLTEGLNPQAKIAGQSRSEHAYATLLYGDEFLLGVRVLGKSIRDTGVTKDMVALVSDGVSDAGIRLLEADGWIVQRIELLANPNSKRPTRFWGVYTKLKIFNMTDYRKVVYLDADTIVTRSIEDLFECQSFCANLKHSERLNSGVMVVEPSRDLFEDMMSKVGNTYSYTGGDQGFLNSYYVGFADAELFNPELSPEIRKARPKKMERLTTLYNADVGLFALANKWMVDASELRVIHYTLGPLKPWDWYAEWLLEPVKMWQDIRVTLEEIIPGTGQGRDPRTSLITWTLFLIPLLALSYMKRALLLQIQKDLFGLASSGSVFFTYARQLWYKYKPGATLPTYSTLITAIHRDPKDANGDAGLSCVVPNYLGISAIAVCFFTLFGSLGLAAFLIPRQVMPWTGFLLTYEWTFFTFLVVFAKYLDYVYSWGRGTATKSLSVAEEISLYSTDKLHSKNSVSWDTETSTYGIVTALVALLIPALPRIFGTTAIFARAGLMVSGVFLLAVVATYSAEKLAVHWFLKGQNDCSYLER

SEQ ID NO: 16 - DNA, 1973 bp, Gossypium hirsutum
  misc_feature 1..1973: note = Ceres Clone ID no. 1887777
  misc_feature 1..1973: note = Encodes the peptide sequence at SEQ ID NO. 17
  source 1..1973: mol_type = other DNA
aaaagctcctcgtgtttatcaacaacctttaattcaatcctaaagggaaaaaaaaaatcaaataaacaaagtaattttatcctcgaggaaatccggatcattttttcgagaaaaccgaatactatgaaattaccaaaactctcgatcctgtttctgcttcttttgattactatacaaacaaaggcggcgttaggggttaaagctcaatcttcatcgaaagaagcttatgtgacgctgctgtacggagatgagttcctcttaggggttagggttttagggaaatcgataagggacactggatcaactaaagacatggtcgttttggtctctgatggcgtctctgattatgctaaaaagcttctaaaggctgatggatggatagtggagatgataagcttattggcaaatccgaatcaagttcggccgaagagattttggggtgtttacaccaaattgaaaatttttaatatgactaactacaagaaagttgtgtatcttgatgcggatactatagtagtcaagagcattgaagatctctttaaatgtcagaaattctgtgcaaatttgaagcattctgagaggttgaattcaggagtcatggtagtggaaccatctgaagctgttttcaatgacatgatgagcaaagtcaatactttgccttcttatactggaggagatcagggttttctgaattcttactactctgatttcccaaatgcacatgtttttgaccctaatatacccgacgaggtgctgaaatcccgtcctgctcctgagatggaacgactctctactctatacaatgcagatgttggtctttacatgcttgccaacaagtggatggtagatgagagtgaacttcgtgtaattcactatacacttggcccccttaaaccttgggattggtggacatcttggcttttgaaaccggtcgatgtctggcagaatgttagggaacagcttaaagagtcccttcctggaactggaggaggcaaaaatccaactgatgagcttctagtcaaattccttttcctcttacctttctgtgctttacttttttgtttctatcgttctttcgttcagacagggggttcagtttgcagaacttcattatgcaatcagatcagacacttctaccatgtagttaggtcgagtgggacagttgcttacactagtgtttcttcatcttctaccattaacgcaagcagtcagtttcctaacagtgcacagaacaaggtgcctgcatacttgggtgcaatttcagttttcgtatgctttatggctgctttggtgtcccttggaatttctatttcaattgtgcctcgacaagtgatgccatggactggtttgctcttgatgtatgagtggacgttttcaatcttctttctttcattcggagcatttcttcatttgatttatctgtggggaaaaagagaaccagggccagtttcctctcgtatggatcctattgattcggattctagaaaaggttatcgacaggcatcctcttgcgatattgttacttggtattatgggttggggatggcttttttggctatcgcagccccatccttaccatgtatttttggaatcaccgctctgttcatgaggttgggtctgatggtcgttggagggcttatattagcggcattcatgacatatgcttcggaacatctagcgattaggtcattcttgaaaggtcttgaagaccggaacaccactcggtcgaggagtgcatgtttcttatgttgaaagaaaacttccaaaatgatcatgattcttaccagcattgcatcatttttccttcaaatttgtgttctatttaacatttaatcacaacagttgatctgtaaaatattgcagtcaattttggctaattagaaatgtaattttttttttccattgctactttgttgtgaaaaatactcagtttcccatataataccatcataattcacatatttctgatcctc

SEQ ID NO: 17 - protein, 542 aa, Gossypium hirsutum
  REGION 1..542: note = Ceres Clone ID no. 1887777
  REGION 35..263: note = Pfam Name: Glyco_transf_8 Pfam Description: Glycosyl transferase family 8
  REGION 1..542: note = Bit score of 1427.5 for HMM based on sequences of Figure 8
  REGION 1..542: note = Functional Homolog Of SEQ ID NO. 2
MKLPKLSILFLLLLITIQTKAALGVKAQSSSKEAYVTLLYGDEFLLGVRVLGKSIRDTGSTKDMVVLVSDGVSDYAKKLLKADGWIVEMISLLANPNQVRPKRFWGVYTKLKIFNMTNYKKVVYLDADTIVVKSIEDLFKCQKFCANLKHSERLNSGVMVVEPSEAVFNDMMSKVNTLPSYTGGDQGFLNSYYSDFPNAHVFDPNIPDEVLKSRPAPEMERLSTLYNADVGLYMLANKWMVDESELRVIHYTLGPLKPWDWWTSWLLKPVDVWQNVREQLKESLPGTGGGKNPTDELLVKFLFLLPFCALLFCFYRSFVQTGGSVCRTSLCNQIRHFYHVVRSSGTVAYTSVSSSSTINASSQFPNSAQNKVPAYLGAISVFVCFMAALVSLGISISIVPRQVMPWTGLLLMYEWTFSIFFLSFGAFLHLIYLWGKREPGPVSSRMDPIDSDSRKGYRQASSCDIVTWYYGLGMAFLAIAAPSLPCIFGITALFMRLGLMVVGGLILAAFMTYASEHLAIRSFLKGLEDRNTTRSRSACFLC

SEQ ID NO: 18 - protein, 479 aa, Oryza sativa
  REGION 1..479: note = Public GI ID no. 57834149
  REGION 36..257: note = Pfam Name: Glyco_transf_8 Pfam Description: Glycosyl transferase family 8
  REGION 1..479: note = Bit score of 870.0 for HMM based on sequences of Figure 8
  REGION 1..479: note = Functional Homolog Of SEQ ID NO. 2
  source 1..479: note = Oryza sativa subsp. japonica
MRSPTPARLALALVAALAAAALLGGAAAAAATEEAYVTLLYGDEFVLGVRVLGKSIRDTGTRRDLVVLVSDGVSDYSRKLLQADGWIVSHITLLANPNQVRPKRFWGVYTKLKIFNMTSYRKVVYLDADTVVVKSIEDLFKCGKFCGNLKHSERMNSGVMVVEPSETVFKDMMRQIDTLPSYTGGCNSVECLYSDQGFLNSYYADFANSHVYEPEKPYTPEPETQRLSTLYNADVGLYMLANKTCSINLLQEKVQEKGEFGWLMKRNLESFTTRWVPLNTGTGGQLWLVKPVGVWQDVRQTLEESLPGTGGGRSPHDQLVVKVLFILPVLLLTCGYNQSCSQFSNGMHSKLPSYFGALTVLACFMSAGVSFAFAFAIIPKQIMPWTGLLLMFEWTFVSFFLLFGSYLRFVYRWGSLDANHVGHSRFDSSENHMVTGRHHNMSDCDIDATFYWTGMAIIAIVTVLLPTLLGVTALFANAE

SEQ ID NO: 19 - protein, 372 aa, Oryza sativa
  REGION 1..372: note = Public GI ID no. 116310214
  REGION 36..259: note = Pfam Name: Glyco_transf_8 Pfam Description: Glycosyl transferase family 8
  REGION 1..372: note = Bit score of 716.8 for HMM based on sequences of Figure 8
  REGION 1..372: note = Functional Homolog Of SEQ ID NO. 2
  source 1..372: note = Oryza sativa subsp. indica
MRSPTPARLALALVAALAAAALLGGAAAAAATEEAYVTLLYGDEFVLGVRVLGKSIRDTGTRRDLVVLVSDGVSDYSRKLLQADGWIVSHITLLANPNQVRPKRFWGVYTKLKIFNMTSYRKVVYLDADTVVVKSIEDLFKCGKFCGNLKHSERMNSGVMVVEPSETVFKDMMRQIDTLPSYTGGDQGFLNSYYADFANSHVYEPEKPYTPEPETQRLSTLYNADVGLYMLANKWMVDEKELRVIHYTLGPLKPWDWWTAWLVKPVGVWQDVRQTLEESLPGTGGGRSPHDQLVVKVLFILPVLLLSFGYYQSCFQTNKELLNIRSLCAFARRDRYKYKSEEAFPSYSVMGVSSSAFSNSNQRVSHLPLFNN

SEQ ID NO: 20 - protein, 537 aa, Arabidopsis thaliana
  REGION 1..537: note = Public GI ID no. 18087513
  REGION 33..261: note = Pfam Name: Glyco_transf_8 Pfam Description: Glycosyl transferase family 8
  REGION 1..537: note = Bit score of 1376.4 for HMM based on sequences of Figure 8
  REGION 1..537: note = Functional Homolog Of SEQ ID NO. 2
MVRLKTSLWVLLLALVSIQLNGSFGSESSKVAYVTLLYGDEFLLGVRVLGKSIRDTGSTKDMVALVSDGVSDYSKKLLKADGWKVEKISLLANPNQVHPTRFWGVYTKLKIFNMTDYKKVVYLDADTIVVKNIEDLFKCSKFCANLKHSERLNSGVMVVEPSEALFNDMMRKVKTLSSYTGRDQGFLNSYYPDFPNARVFDPSVTPEVLKTRPVPAMERLSTLYNADVGLYMLANKWMVDDSKLHVIHYTLGPLKPWDWWTAWLVKPVDAWHSIRVKLEETLPGTGGGSNQHDELVVKFLFLLPLCALLFCIYRSIQGREGSLCWSSFSNQIRYLYYKVRSNGTLGYGGVSTMSPSYQPHSGNAQSKVPQHLGAVSVVVCFTAVLLSLEISFAIVPRQIMPWTGLVLVYEWTFTIFFLLFGVFLLFVHQHGKRIAIQSESSSLDDSAKVHQRAGGSCDVTTLYYGLGMAFLAIAAVSLPYILGITALFTRLGLMVGLAIILAAFMTYASEHLAVRWFLKGLEDRRDTTRSNSLCFLC

SEQ ID NO: 21 - protein, 587 aa, Vitis vinifera
  REGION 1..587: note = Public GI ID no. 147841543
  REGION 32..260: note = Pfam Name: Glyco_transf_8 Pfam Description: Glycosyl transferase family 8
  REGION 1..587: note = Bit score of 1271.8 for HMM based on sequences of Figure 8
  REGION 1..587: note = Functional Homolog Of SEQ ID NO. 2
MKSRLFNFWFLLILLAWIRSPSPVRASGSEAYVTLLYGDEFLLGVRVLGKSIRDTGSTKDMVVLVSDGVSDYAKKLLQADGWIVELISLLANPNQVRPKRFWGVYTKLKIFNMTNYKKVVYLDADTIVVKSIEDLFKCGKFCANLKHSERLNSGVMVVEPSETVFNDMMSKVKTLPSYTGGDQGFLNSYYTGFASAHVFDPDLSPEERNARPVPKMERLSTLYNADVGLYMLANKWMVDEEKLRVIHYTLGPLKPWDWWTSWLLKPVDVWQNVREQLEGSLPGTEGGRNPNDTILVKFLFLIPLLALLFCYYRSFLQFSNGAQSKVPVYLGGISVVICFMVAVVSLALALSVVPRQVMPWTGLLLMYEWAFTSFFLLFGGYLHLIYQWGKMTASQAGSFASRPVSADYDSGKGHQRQVSSCDAATWYYGLGMAFLAVAAPSLPCVFGVTALFLRFIIGKVRGGLYRLGLIAVGALILASFMTYAAEHLAIRSFVKGLEDRDTPRSRSTSIVVKDFNMGAQLIKGRSKDDVYEWLGYSTTQVSNLQGHVSTKSTFQEGITLGHPFRKILHDLVSHKSIEVSSPSYTLY

SEQ ID NO: 22 - protein, 568 aa, Physcomitrella patens
  REGION 1..568: note = Public GI ID no. 168014382
  REGION 54..279: note = Pfam Name: Glyco_transf_8 Pfam Description: Glycosyl transferase family 8
  REGION 1..568: note = Bit score of 1160.8 for HMM based on sequences of Figure 8
  REGION 1..568: note = Functional Homolog Of SEQ ID NO. 2
MRREHRVFALFLLVVFCNVLRSDAGSSSRDLLAESFIPQTKNVQQKRSGQAYATLLYGDEFLLGVRVLGKSIRNTGVAKDMVALVSDGVSETGIRLLKADGWIVQRIKLLANPNSKRPTRFWGVYTKLKIFNMTEYSKVVYLDADTIVTRSIEDLFECQGFCANLKHSERLNSGVMVVEPSSSLFEDMISKVQTTYSYTGGDQGFLNSYYVGFADAELFNPQLPPEIRKARPKKMERLTTLYNADVGLFALANKWMVDASELRVIHYTLGPLKPWDWYAEWLLEPVKMWQDIRITLEEVLPGTGQGRDPHISLITWTLFLVPLIVLCYIKRTLLLQIQKDLFALVCSGSVFCTYANQLWYKYKPGVTLPTYFTSGAAVSNGCKHQGCPKGASGDAGLSCRVPKHLGMMAIVACFFALFASLGLAAFLVPRQVMPWTGLLLTYEWTFFTFLLLFGKFLDYIYSLGRNTAIKSLSIAEEISFYSAEKLHSKNSTYWDAETSTYGIVAALTALLIPTLPWIFGTTAIFARAGLMVSGGFVLAVVGTYSAEQLAVHWFLRGHDDCSHMERSS

SEQ ID NO: 23 - DNA, 1209 bp, Solanum lycopersicum
  misc_feature 1..1209: note = Ceres Annot ID no. 8462062
  misc_feature 1..1209: note = Encodes the peptide sequence at SEQ ID NO. 24
  source 1..1209: mol_type = other DNA
atggtggtgtatcttgacgctgatactattgttgttaaaagcattgaagatctgtttaaatgtgggaagttctgtgcaaatttaaaacattctgagagactgaattctggagtcatggtggttgagccatcagaaaaagtttttaatgatatgatgagcaaggtgaccactttgccttcttacactggaggtgatcaaggttttctcaactcctactatgttgggtttgctaatgctcaggtttatgagccaaatttgccgtcagatgtcttaaattccagaaaggttccagaaatggagagactttctactctttacaatgcagatgttggcctctacatgcttgctaacaagtggatggtggatgaaaaagaacttcgagttattcattacacacttggcccgcttaaaccgtgggattggtggacgtcttggctgttaaaacctgttgatgtctggcagaatgtcagggtacaacttcaagaatctctacctggaactagaggcggcaaaaattccagagatgaacttcttgtcaaatttctttatttgcttccattgcttctgatagcattttgttactatcggtcgttcttacagacacaatcactatggcaccatatcagacaaatgtactacaaggtcagaggaggtgtcctagcttatgcctctgttcctccatctgccatcagctccaaccagcagttgaagatgcctacttatctgggtgcggtatctgtctgtgtctgttttgctgctgctcttgtgtcccttggtcttccacttttaatcattccgcgccaagtaatgccatggactggtctcctccttatgtacgaatggacatttacacttttcttcctcttgttcggaagttatctgcacttagtttatcagtggggaagggttgcggcaaatcaacctggtcaatttccggctcatcctgtatctttggattatgaacctggaaaaggtcatcagcggcaacaatcatgttgtgacaatgaagcatggtactatgggttagggatggcatttcttgccattgcagccccagcattgcctggtgtttttggagtcacttctttgtttttgagtttcatcactcaggtagaatttcttggtgatgctgttggcttctccgaacgtccaatttctcaccctctcctttgttttcttgtccgtctttacaaatacctcttgttgtga

SEQ ID NO: 24 - protein, 402 aa, Solanum lycopersicum
  REGION 1..402: note = Ceres Annot ID no. 8462062
  REGION 94..172: note = Pfam Name: Glyco_transf_8 Pfam Description: Glycosyl transferase family 8
  REGION 1..402: note = Bit score of 659.8 for HMM based on sequences of Figure 8
  REGION 1..402: note = Functional Homolog Of SEQ ID NO. 2
MVVYLDADTIVVKSIEDLFKCGKFCANLKHSERLNSGVMVVEPSEKVFNDMMSKVTTLPSYTGGDQGFLNSYYVGFANAQVYEPNLPSDVLNSRKVPEMERLSTLYNADVGLYMLANKWMVDEKELRVIHYTLGPLKPWDWWTSWLLKPVDVWQNVRVQLQESLPGTRGGKNSRDELLVKFLYLLPLLLIAFCYYRSFLQTQSLWHHIRQMYYKVRGGVLAYASVPPSAISSNQQLKMPTYLGAVSVCVCFAAALVSLGLPLLIIPRQVMPWTGLLLMYEWTFTLFFLLFGSYLHLVYQWGRVAANQPGQFPAHPVSLDYEPGKGHQRQQSCCDNEAWYYGLGMAFLAIAAPALPGVFGVTSLFLSFITQVEFLGDAVGFSERPISHPLLCFLVRLYKYLLL

SEQ ID NO: 25 - DNA, 488 bp, Panicum virgatum
  misc_feature 1..488: note = Ceres Clone ID no. 1955766
  misc_feature 1..488: note = Encodes the peptide sequence at SEQ ID NO. 26
  source 1..488: mol_type = other DNA
attacccctcaaacatacacgaagaagcagcattcgaagtgcttacatcttgtgagattaaaatctgcaggtatatatctctgaagaagatgagcagctcggcagttggtgagggcaaggggtgtgatgctactcccaagacagagtggcctgagctagtgggaagcacgatcaaggaggcgacggagaagatcaatgcggagcggccggacctcaatgtggagccggtccctgttggcaccatagtcccccaagatttcgacccgaagcgcgtccgtctctgggttgacaccgtcgccgaggtccccaggattggctgaaccagcttaacgcaaagccaccgaataatgaatgctacatgcatgtgttccacagaccattctacataggtcaattaaataaataaaaaatatggctgtgatggagcgttctggtatgctattaaaattgtcatgtttcggatatacacaattattattttcaatatc

SEQ ID NO: 26 - protein, 76 aa, Panicum virgatum
  REGION 1..76: note = Ceres Clone ID no. 1955766
  REGION 17..76: note = Pfam Name: potato_inhibit Pfam Description: Potato inhibitor I family
  REGION 1..76: note = Bit score of 156.9 for HMM based on sequences of Figure 12
  REGION 1..76: note = Figure 12
MSSSAVGEGKGCDATPKTEWPELVGSTIKEATEKINAERPDLNVEPVPVGTIVPQDFDPKRVRLWVDTVAEVPRIG

SEQ ID NO: 27 - DNA, 544 bp, Triticum aestivum
  misc_feature 1..544: note = Ceres Clone ID no. 570179
  misc_feature 1..544: note = Encodes the peptide sequence at SEQ ID NO. 28
  source 1..544: mol_type = other DNA
atctggaaagcaagccggtgctaggaacgatcaaatcacatagaagtgcatagaggtcgtggcgtttgcccaatttcattcccaccatgagcaagccatgcgacggtgccaatcccaagacggagtggcctgagctggtcgggcgcacgatcaaggaggcggaggagaagatcaaggcggaccgaccggacctcaaagttgtcattgtcccggtaggaagtgttgtgacacaggaggtcgatctgaaccgcgtccgcgtctgggtcgacacagtggcggaggttcccaagattggctaagctagcttgtaattagccaactggaataaaagcccatgcaagtctcaacatcgtccagttaatttgccgaacaaataagcatgggtatgttgtgaagaaaaataagtattgttggtgttttgcggaaatgtatcatgtgtggatctgttatgtatgttattttgttgtaagttgtaataagcatcgttaatattatctggccctgtttatattgtctaataaatataatctactttagcggagcg

SEQ ID NO: 28 - protein, 70 aa, Triticum aestivum
  REGION 1..70: note = Ceres Clone ID no. 570179
  REGION 11..70: note = Pfam Name: potato_inhibit Pfam Description: Potato inhibitor I family
  REGION 1..70: note = Bit score of 154.3 for HMM based on sequences of Figure 12
  REGION 1..70: note = Functional Homolog Of SEQ ID NO. 26
  REGION 1..70: note = Figure 12
MSKPCDGANPKTEWPELVGRTIKEAEEKIKADRPDLKVVIVPVGSVVTQEVDLNRVRVWVDTVAEVPKIG

SEQ ID NO: 29 - protein, 65 aa, Oryza sativa
  REGION 1..65: note = Public GI ID no. 54290293
  REGION 6..65: note = Pfam Name: potato_inhibit Pfam Description: Potato inhibitor I family
  REGION 1..65: note = Bit score of 148.4 for HMM based on sequences of Figure 12
  REGION 1..65: note = Functional Homolog Of SEQ ID NO. 26
  REGION 1..65: note = Figure 12
  source 1..65: note = Oryza sativa subsp. japonica
MCKTPKTEWPELVCRTIKEAKEKIKADRPDLKIEVVPVGTIVTQEFDENRVRIWVDTVAKTPTIG

SEQ ID NO: 30 - protein, 68 aa, Hordeum vulgare
  REGION 1..68: note = Public GI ID no. 1617121
  REGION 9..68: note = Pfam Name: potato_inhibit Pfam Description: Potato inhibitor I family
  REGION 1..68: note = Bit score of 153.4 for HMM based on sequences of Figure 12
  REGION 1..68: note = Functional Homolog Of SEQ ID NO. 26
  REGION 1..68: note = Figure 12
MSKSCDGAKTEWPELVGCTIKEAKEKIKADRPDLKVVIVPVGSIVTQEIDLNRVRVWVDKVAKVPKIG

SEQ ID NO: 31 - DNA, 222 bp, Sorghum bicolor
  misc_feature 1..222: note = Ceres Annot ID no. 8724383
  misc_feature 1..222: note = Encodes the peptide sequence at SEQ ID NO. 32
  source 1..222: mol_type = other DNA
atgagctccacggcgacggcggcggattgcggcggcgccaagacgtcgtggccggaggtggtcgggaagagcgtggaggaagcaaagaaggtgatcctcaaggacaagcctgacgccgacatcgtcgtgctgcccgtcggcacgattgtgaccgcagattttgtgcccagccgcgtgcgtatcttcgtcgacaccgtcgcccagacaccccacatcggctga

SEQ ID NO: 32 - protein, 73 aa, Sorghum bicolor
  REGION 1..73: note = Ceres Annot ID no. 8724383
  REGION 14..73: note = Pfam Name: potato_inhibit Pfam Description: Potato inhibitor I family
  REGION 1..73: note = Bit score of 168.0 for HMM based on sequences of Figure 12
  REGION 1..73: note = Functional Homolog Of SEQ ID NO. 26
  REGION 1..73: note = Figure 12
MSSTATAADCGGAKTSWPEVVGKSVEEAKKVILKDKPDADIVVLPVGTIVTADFVPSRVRIFVDTVAQTPHIG

SEQ ID NO: 33 - DNA, 555 bp, Zea mays
  misc_feature 1..555: note = Ceres Clone ID no. 896724
  misc_feature 1..555: note = Encodes the peptide sequence at SEQ ID NO. 34
  source 1..555: mol_type = other DNA
ctctagctggctgaacgggtctacaaatatacactactactccactaatgtcacatatccacaaccaggtgatctcaagtaattaacagaaaatatattccatcattgaaaatgagttccgttgttttgggtgctactggtagggagaataagacatcatggcctgaggtggtgggcatgtccatcaaggaggcaagagagatcattcttaaagacatgcccaacgctaacattcaagttctaccggttggctcgcttgtgacccaagactttcgccctgatcgtgttcgcatcttcgttgatattgttgcccagactccaacagttggctgacaaggatatgccttatctataggccaaataaacaaagcctacttttatgtatcatggctaataaatcctacatttcttggttatccttgattggtttagcttattagctatatcgccatcaaaaggggccccaagaaattacatgtatgtctatcataaaaatctcatcccgatggaatatataataaataaataatgatatatgcaatccgtaactatgcc

SEQ ID NO: 34 - protein, 73 aa, Zea mays
  REGION 1..73: note = Ceres Clone ID no. 896724
  REGION 14..73: note = Pfam Name: potato_inhibit Pfam Description: Potato inhibitor I family
  REGION 1..73: note = Bit score of 168.0 for HMM based on sequences of Figure 12
  REGION 1..73: note = Functional Homolog Of SEQ ID NO. 26
  REGION 1..73: note = Figure 12
MSSVVLGATGRENKTSWPEVVGMSIKEAREIILKDMPNANIQVLPVGSLVTQDFRPDRVRIFVDIVAQTPTVG

SEQ ID NO: 35 - DNA, 433 bp, Glycine max
  misc_feature 1..433: note = Ceres Clone ID no. 607452
  misc_feature 1..433: note = Encodes the peptide sequence at SEQ ID NO. 36
  source 1..433: mol_type = other DNA
aatcaagtctcacgcacagcgcaagtccaacttgctagcctgtcaatcatcgaatatcatcggccgtccgcgcgtccatcagctcggagaagaccgtccatcaatcgtgctacgaagatgagttcctccgacgacctcgccggtggaaagaagacttcgaggccggaggtggtcgggctgaccatcaagaaggccaaggagatcatccttaaggacaagcccgacgccgacatcgtcgtggtgccggtcggctccgccgtgaccgaggacttgaggcccaaccgtgtccgcatcttcgtgggcaccgtcgccgagatcccccacgttggctagttggattgcctttgcttgctgtggccggcatagatgctggctcatgaataaatcaataatggaggaataaaaatgtatgcaggttatatgttttatcggt

SEQ ID NO: 36 - protein, 71 aa, Glycine max
  REGION 1..71: note = Ceres Clone ID no. 607452
  REGION 12..71: note = Pfam Name: potato_inhibit Pfam Description: Potato inhibitor I family
  REGION 1..71: note = Bit score of 157.3 for HMM based on sequences of Figure 12
  REGION 1..71: note = Functional Homolog Of SEQ ID NO. 26
  REGION 1..71: note = Figure 12
MSSSDDLAGGKKTSRPEVVGLTIKKAKEIILKDKPDADIVVVPVGSAVTEDLRPNRVRIFVGTVAEIPHVG

SEQ ID NO: 37 - protein, 69 aa, Brachypodium distachyon
  REGION 1..69: note = Public GI ID no. 37904392
  REGION 10..69: note = Pfam Name: potato_inhibit Pfam Description: Potato inhibitor I family
  REGION 1..69: note = Bit score of 146.1 for HMM based on sequences of Figure 12
  REGION 1..69: note = Bit score of 146.1 for HMM based on sequences of Figure 12
  REGION 1..69: note = Functional Homolog Of SEQ ID NO. 26
  REGION 1..69: note = Figure 12
MSSSSVGEVTKSWPEVVGLSIKEAKKVILKDKPDADIVALPVGGKVTDDFLSNRVRIFVDTGGEIPRAG

SEQ ID NO: 38 - DNA, 488 bp, Panicum virgatum
  misc_feature 1..488: note = Ceres Clone ID no. 1870473
  misc_feature 1..488: note = Encodes the peptide sequence at SEQ ID NO. 39
  source 1..488: mol_type = other DNA
attacccctcaaacatacaagaagaagcagcattcgaagtgcttacatcttgtggtatatatctctgaagaagatgagcagctcggcagttggtgatggcaaggggtgtgatgctactcccaagacagagtggcctgagctagtgggaagcacgatcaaggaggcgacggagaagatcaatgcggagcggccggacctcaatgtggagccggtccctgttggcaccatagtcccccaagatttcgacccgaagcgcgtccgtctctgggttgacaccgtcgccgaggtccccaggattggctgaaccagcttaacgcaaagccaccgaataatgaatgctacatgcatgtgttccacagaccattctacataggtcaattaaataaataaaaaatatggctgtgatggagcgttctggtatgccattaaaattgttatgtttcggatatacaccattattatttgcaatatcagaaacatgctattac

SEQ ID NO: 39 - protein, 76 aa, Panicum virgatum
  REGION 1..76: note = Ceres Clone ID no. 1870473
  REGION 17..76: note = Pfam Name: potato_inhibit Pfam Description: Potato inhibitor I family
  REGION 1..76: note = Bit score of 155.8 for HMM based on sequences of Figure 12
  REGION 1..76: note = Functional Homolog Of SEQ ID NO. 26
MSSSAVGDGKGCDATPKTEWPELVGSTIKEATEKINAERPDLNVEPVPVGTIVPQDFDPKRVRLWVDTVAEVPRIG

SEQ ID NO: 40 - DNA, 499 bp, Panicum virgatum
  misc_feature 1..499: note = Ceres Clone ID no. 2026564
  misc_feature 1..499: note = Encodes the peptide sequence at SEQ ID NO. 41
  source 1..499: mol_type = other DNA
actacccatcaaacaaacaacaacaacaacaagaagcatcattcaaagtgcttacatcttgtgagattgaaatctgcaggtatctctgaagaagatgagcagctcggcaggtggtgatggcaaggggtgcgatgctgctcccaagacagagtggcctgagctagtgggaaagacgatcaaggaggcgacggagaagatcaatgcggagcggccggacctcaatgtggaggcggtccctgttggcaccatagtcaccccagtgttcgacccgacgcgcgtccgtctctgggttgacaccgtcgccgagatccccaggattggctaaaaaagaagcttaacgcaaagccaccgaataatggatggtacatgcatgcatgtgttcctcagaccaatatactagtacataggtcaattagactagaacattcggcccgcgatgcgcgccctaccatttcaacaatcaaatccagcaatacaataaaatcaaataaaattcaag

SEQ ID NO: 41 - protein, 76 aa, Panicum virgatum
  REGION 1..76: note = Ceres Clone ID no. 2026564
  REGION 17..76: note = Pfam Name: potato_inhibit Pfam Description: Potato inhibitor I family
  REGION 1..76: note = Bit score of 144.1 for HMM based on sequences of Figure 12
  REGION 1..76: note = Functional Homolog Of SEQ ID NO. 26
MSSSAGGDGKGCDAAPKTEWPELVGKTIKEATEKINAERPDLNVEAVPVGTIVTPVFDPTRVRLWVDTVAEIPRIG

SEQ ID NO: 42 - DNA, 645 bp, Panicum virgatum
  misc_feature 1..645: note = Ceres Clone ID no. 2004365
  misc_feature 1..645: note = Encodes the peptide sequence at SEQ ID NO. 43
  source 1..645: mol_type = other DNA
atccatcatcgaacacaaaagaaaaaacatcaatcaaagtgcttacatctttgaggtaagccacaatacatgcgcccccttcaatttcctattgttctttgttcgtttagctatgaacattgcaaaagaagaacaagaaactgattgaagcccgtagttctggtttgcttcgtttctactactttgtgtagcctgaactcccatttttaacaaatggggcgcagaaattctgcaggtatctctgaagaagatgagctcaacagctgacagcaaggggtgcaatgctactcccaagacggagtggcctgagctagtgggatgcacgatcaaagaggcgatggagaggatcaaggcggagcggccgcacctcaatgtcgtgcctgtccctgtaggctcctttgtcacccaagaggttgaccctaatcgcgtccgtctctgggttgacatcgtcgccgaggttcctaaaattggctgaagcatcgaaacgccaagccaccaaataatggcatttgtgtgtgttcctatggaccattcatgtgggttaagtaaataaaagcatgtctgtgatggactcttgtatatggttcgcctgtcataagttgtgaattgtgatgattgagttattaataatacgttggcaacacc

SEQ ID NO: 43 - protein, 74 aa, Panicum virgatum
  REGION 1..74: note = Ceres Clone ID no. 2004365
  REGION 15..74: note = Pfam Name: potato_inhibit Pfam Description: Potato inhibitor I family
  REGION 1..74: note = Bit score of 148.6 for HMM based on sequences of Figure 12
  REGION 1..74: note = Functional Homolog Of SEQ ID NO. 26
MSSTADSKGCNATPKTEWPELVGCTIKEAMERIKAERPHLNVVPVPVGSFVTQEVDPNRVRLWVDIVAEVPKIG

SEQ ID NO: 44 - DNA, 491 bp, Panicum virgatum
  misc_feature 1..491: note = Ceres Clone ID no. 2020677
  misc_feature 1..491: note = Encodes the peptide sequence at SEQ ID NO. 45
  source 1..491: mol_type = other DNA
atcatccatcatcgaacacacaagaaaaaacatcaatcaaagtgcttacatctttgagaaattctgcaggtatctctgaagaagatgagctcaacagctggcagcaaggggtgcaatgctactcccaagacggagtggcctgagctagtgggatgcacgatcaaggaggcgatggagaggatcaaggcggagcggccgcacctcaatgtcgtgcctgtccctgtaggctcctttgtcacccaagaggttgaccctaatcgcgtccgtctctgggttgacatcgtcgccgaggttcctaaaattggctgaagcatcgaaacgccaagccaccaaataatggcatttgtatgtgttcctatggaccattcatgtgggttaagtaaataaaagcatgtctgtgatggactcttgtatatggttcgcctgtcataagttgtgaattgtgatgattgagttatgaataatacgttggcaacactatcggaatctgc

SEQ ID NO: 45 - protein, 74 aa, Panicum virgatum
  REGION 1..74: note = Ceres Clone ID no. 2020677
  REGION 15..74: note = Pfam Name: potato_inhibit Pfam Description: Potato inhibitor I family
  REGION 1..74: note = Bit score of 146.0 for HMM based on sequences of Figure 12
  REGION 1..74: note = Functional Homolog Of SEQ ID NO. 26
MSSTAGSKGCNATPKTEWPELVGCTIKEAMERIKAERPHLNVVPVPVGSFVTQEVDPNRVRLWVDIVAEVPKIG

SEQ ID NO: 46 - DNA, 519 bp, Panicum virgatum
  misc_feature 1..519: note = Ceres Clone ID no. 2039538
  misc_feature 1..519: note = Encodes the peptide sequence at SEQ ID NO. 47
  source 1..519: mol_type = other DNA
atcatccatcagcgaacacacaagaaaaaacatcaatcaaagtgcttacatctttgaggtatctctgaagaagatgagctcaacagctgacagcaaggggtgcaatgctactcccaagacggagtggcctgagctagtgggatgcacgatcaaggaggcgatggagaggatcaaggcggagcggccgcaactcaatgtcgtgcctgtccctgtagactcctttgtcacccaagaggttgaccctaatcgcgtccgtctctgggttgacatcgtcgccgaggttcctaaaattggctgaagcatcgaaacgccaagccaccaaataatggcatttgtatgtgttcctatggaccattcatgggggttaagtaaataaaagcatgtctgtgatgggctcttgtatatggttcgcctgtcataagttgtgaattgtgatgattgagttatgaataatacgttggcaacactatcggaatctgcagctttggggctttgctgatgagtgttgccgagtgccac

SEQ ID NO: 47 - protein, 74 aa, Panicum virgatum
  REGION 1..74: note = Ceres Clone ID no. 2039538
  REGION 15..74: note = Pfam Name: potato_inhibit Pfam Description: Potato inhibitor I family
  REGION 1..74: note = Bit score of 142.3 for HMM based on sequences of Figure 12
  REGION 1..74: note = Functional Homolog Of SEQ ID NO. 26
MSSTADSKGCNATPKTEWPELVGCTIKEAMERIKAERPQLNVVPVPVDSFVTQEVDPNRVRLWVDIVAEVPKIG

SEQ ID NO: 48 - DNA, 563 bp, Triticum aestivum
  misc_feature 1..563: note = Ceres Clone ID no. 844611
  misc_feature 1..563: note = Encodes the peptide sequence at SEQ ID NO. 49
  source 1..563: mol_type = other DNA
atctggaaagcaagccagtgctagaaaagaccaaatcacatagaggtacatagagctgctggcgtttgtccaatttcgtttcaacatgagcacgccatgcgacggccccaagacggagtggcctgagctggtcggccggacgatcaaggaggcggaggagaagatcaaggcggaccgaccggacctcaccgtggatgttgtcccagtaggaactaatgtgacgggtgagttcaatgagaaccgcgtccgcgtctgggtcgacacggtggcggaggttccccggattggctaagctgcttttaattagcctacaggaatactggcccgtgcaggtctccacatcgtctagttaatcgaccgaataaataagcatgggcacggtctgaaaaatgtatggatgtactatgtcatgttgttctgttgtgagttgtaagcatgagtaatattgtggagccactggttattgtttaagagatataatctactttggcattaggacatgctctgtgaattttttttttcttcgacaaaggatgaattttattggctcaaaattgagcacc

SEQ ID NO: 49 - protein, 68 aa, Triticum aestivum
  REGION 1..68: note = Ceres Clone ID no. 844611
  REGION 9..68: note = Pfam Name: potato_inhibit Pfam Description: Potato inhibitor I family
  REGION 1..68: note = Bit score of 140.4 for HMM based on sequences of Figure 12
  REGION 1..68: note = Functional Homolog Of SEQ ID NO. 26
MSTPCDGPKTEWPELVGRTIKEAEEKIKADRPDLTVDVVPVGTNVTGEFNENRVRVWVDTVAEVPRIG

SEQ ID NO: 50 - protein, 67 aa, Oryza sativa
  REGION 1..67: note = Public GI ID no. 125526847
  REGION 8..67: note = Pfam Name: potato_inhibit Pfam Description: Potato inhibitor I family
  REGION 1..67: note = Bit score of 152.7 for HMM based on sequences of Figure 12
  REGION 1..67: note = Functional Homolog Of SEQ ID NO. 26
  source 1..67: note = Oryza sativa subsp. indica
MSSSETPKTEWPELVCRTIKEAKEKIKADRPDLKIEVVPVGTIVTQEFDENRVRIWVDTVAKTPTIG

SEQ ID NO: 51 - DNA, 517 bp, Triticum aestivum
  misc_feature 1..517: note = Ceres Clone ID no. 597887
  misc_feature 1..517: note = Encodes the peptide sequence at SEQ ID NO. 52
  source 1..517: mol_type = other DNA
atctggaaagcaagccagtgctagaaacgaccaaatcacatagaggtacatagagctggtggcgtttgtccaatttcgtttccaacatgagcaagcaaggcgacggtcccaagactgagtggccggagctggtcgggcgcacgatcaaggaggcaaaggagaagatcaaggcggaccggccggacctcaaagtcagaattgtcccggtaggaagtattgtgacagcagacttggatttgaaccgcgttcgcgtttgggtcgacacggtggcagaggttcccaagattggctaatatagcttataattagcctatcactgaaataaaggcccatggaagtctccacttcgttcagttaattggccgaataaataagcatgggtacagtttgaaaaaaatgtatggatgtgctatgtaatgttgttttgtttttgtttttgtttttgttttatttttgaggataactcgccgctttatttatctaatgaaagtttgggatctccttgaagaccacatcc

SEQ ID NO: 52 - protein, 68 aa, Triticum aestivum
  REGION 1..68: note = Ceres Clone ID no. 597887
  REGION 9..68: note = Pfam Name: potato_inhibit Pfam Description: Potato inhibitor I family
  REGION 1..68: note = Bit score of 146.4 for HMM based on sequences of Figure 12
  REGION 1..68: note = Functional Homolog Of SEQ ID NO. 26
MSKQGDGPKTEWPELVGRTIKEAKEKIKADRPDLKVRIVPVGSIVTADLDLNRVRVWVDTVAEVPKIG

SEQ ID NO: 53 - protein, 67 aa, Oryza sativa
  REGION 1..67: note = Public GI ID no. 58396949
  REGION 8..67: note = Pfam Name: potato_inhibit Pfam Description: Potato inhibitor I family
  REGION 1..67: note = Bit score of 147.4 for HMM based on sequences of Figure 12
  REGION 1..67: note = Functional Homolog Of SEQ ID NO. 26
  source 1..67: note = Oryza sativa subsp. japonica
MSSSWTPKTEWPELVCRMIKEAKEKIKADRPDLKIEVVPVGTIVTQEFDENRVRIWVDTVAKTPTIG

SEQ ID NO: 54 - DNA, 502 bp, Triticum aestivum
  misc_feature 1..502: note = Ceres Clone ID no. 684778
  misc_feature 1..502: note = Encodes the peptide sequence at SEQ ID NO. 55
  source 1..502: mol_type = other DNA
tctggaaagtagaaagcaagccagtgctaggaacgaccaaatcacatagagctagatagagctggtggcatttgtacgatttctttccaacatgagcaagccatgcgacgccaagacagagtggcctgagctggtcggacgcacgatcaaggaggcggaggagaagatcaaggcggaccggccggacctcaaagtcatcattgtcccggtaggaagttttgtgacaacagacgtcgatttgaaccgcgttcgcgtctgggtcgacacggtggcggaggttcccaagattggctaagctagcttaattagcctatcactggaataaaggcccatgccctccactttgttcagttaattggccgaataaataagcatgggtacagtctgaaaaatgtacggatgtgctatgtaatgttgttttgtatgtgagttgtaagcatcagtaatattgtcgagccactgtttattgttcaagaaatataatctacttcagcattagggc

SEQ ID NO: 55 - protein, 67 aa, Triticum aestivum
  REGION 1..67: note = Ceres Clone ID no. 684778
  REGION 8..67: note = Pfam Name: potato_inhibit Pfam Description: Potato inhibitor I family
  REGION 1..67: note = Bit score of 139.5 for HMM based on sequences of Figure 12
  REGION 1..67: note = Functional Homolog Of SEQ ID NO. 26
MSKPCDAKTEWPELVGRTIKEAEEKIKADRPDLKVIIVPVGSFVTTDVDLNRVRVWVDTVAEVPKIG

SEQ ID NO: 56 - DNA, 504 bp, Triticum aestivum
  misc_feature 1..504: note = Ceres Clone ID no. 699511
  misc_feature 1..504: note = Encodes the peptide sequence at SEQ ID NO. 57
  source 1..504: mol_type = other DNA
atctggaaagcaagccagtgctagaaacgaccaaatcacatagaggtacatagagctggtggcgtttgtccaatttcgtttccaacatgagcacgccaggcgacggtcccaagacggagtggccggagctggtcgggcgcacgatcamssaggcgaaggagaagatcaaggcggaccggccggacctcaaagtcagaattgtcccggtaggaagtactattgtgacagcagacttcgatttgaatcgcgttcgcgtctgggtcgatacggtggcagaggttcccaagattggctaagctagcttaattagcctatactggaataaaggcccatgcaagtctccacttcgttcagttaatctgccgaataaataagcatgggtgcagtctggaaaaaaaatgtatggatgtgctgtgtaatgttgttttgtttgtgagttgtaaacatcagtaatattgtcgagccactgtttattgttcaagaaatatattctacttcaaccgc

SEQ ID NO: 57 - protein, 69 aa, Triticum aestivum
  REGION 1..69: note = Ceres Clone ID no. 699511
  REGION 9..69: note = Pfam Name: potato_inhibit Pfam Description: Potato inhibitor I family
  REGION 1..69: note = Bit score of 131.6 for HMM based on sequences of Figure 12
  REGION 1..69: note = Functional Homolog Of SEQ ID NO. 26
  VARIANT 21: note = X can be any amino acid
  VARIANT 22: note = X can be any amino acid
MSTPGDGPKTEWPELVGRTIXXAKEKIKADRPDLKVRIVPVGSTIVTADFDLNRVRVWVDTVAEVPKIG

SEQ ID NO: 58 - DNA, 480 bp, Panicum virgatum
  misc_feature 1..480: note = Ceres Clone ID no. 1803377
  misc_feature 1..480: note = Encodes the peptide sequence at SEQ ID NO. 59
  source 1..480: mol_type = other DNA
acaagaaagccacttctagccatcaacaacgacttcttcaccatcatcgtcacctaactcagacagtattagcgactgaagaagaagaagaagaagaagatgagctcctccgcggaaccagctatgtgcggcggcggcggcaagacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtatgaataataatggatgtgtgttctttccctataaatcaaataaataagcaagggatgtgcccccggcatgtccctttcctctaaataatgcc

SEQ ID NO: 59 - protein, 74 aa, Panicum virgatum
  REGION 1..74: note = Ceres Clone ID no. 1803377
  REGION 15..74: note = Pfam Name: potato_inhibit Pfam Description: Potato inhibitor I family
  REGION 1..74: note = Bit score of 157.3 for HMM based on sequences of Figure 12
  REGION 1..74: note = Functional Homolog Of SEQ ID NO. 26
MSSSAEPAMCGGGGKTSWPEVVGMSIEEAKKVILKDKPDADIQVLPVGTPVTKDFRPNRVRIFVNTVAETPHVG

SEQ ID NO: 60 - DNA, 560 bp, Panicum virgatum
  misc_feature 1..560: note = Ceres Clone ID no. 1888961
  misc_feature 1..560: note = Encodes the peptide sequence at SEQ ID NO. 61
  source 1..560: mol_type = other DNA
accaacagtacaagaagcacaagaaagtcacttctatagccatcaccaacgacttcttcgccatcatcgtcacctaactcagaccctagctagcgactgaagaagaagatgagctcctccccagcggaaccagctgtgtgcggcggcggcggcaagacgtcgtggccggaggtggtggggatgagcatagaggaggccaagaaggtgatcctcaaagacaagcccgacgccgacatccaggtgctgccggtcggcacgccggtgaccaaggatttccaccccaaccgtgtccggatcttcgtcaacaccgtcgccgagacgccccatgtgggctagcttagctgctcatagctgttgctcagagcatcatgctgtgtgccaaataaagccatcttcagtatgaataatggatgtgtgttttttccctataaatcaaataaataagcaagggatgtgcccccagcatgtccctttcgtctaaataatgccatattatgtgtaaagcatcgatcgtatcctgtcctggcatgaaaaagatgaatcagctatatcagcggacc

SEQ ID NO: 61 - protein, 75 aa, Panicum virgatum
  REGION 1..75: note = Ceres Clone ID no. 1888961
  REGION 16..75: note = Pfam Name: potato_inhibit Pfam Description: Potato inhibitor I family
  REGION 1..75: note = Bit score of 148.4 for HMM based on sequences of Figure 12
  REGION 1..75: note = Functional Homolog Of SEQ ID NO. 26
MSSSPAEPAVCGGGGKTSWPEVVGMSIEEAKKVILKDKPDADIQVLPVGTPVTKDFHPNRVRIFVNTVAETPHVG

SEQ ID NO: 62 - DNA, 476 bp, Triticum aestivum
  misc_feature 1..476: note = Ceres Clone ID no. 897331
  misc_feature 1..476: note = Encodes the peptide sequence at SEQ ID NO. 63
  source 1..476: mol_type = other DNA
tcaagtagtacaacacaaagctctctatcaggaattcgatcaggatcgtcgttcaccagtctgaggctcgagagtgcgtggttcacttcaacagtacgagaatgagctcctcggacgacacctgcggcaagaaggcgtcgtggccggagctggttgggaagtccatcgaggaggccaagaagaccatcatgaaggacaggccggacgtgaagaacatcgaggtcttcccggtcggcacaccggtgaccggggacttcaggcccgaccgtgtccgcatcttcgtcgacaccgttgcggagaccccccgcattggctaactttgattgatgctccatcgtttatgtgtgtgtgtgtgttatattccagaataaaccatagctagtgagtagtggccatgtatgcatactgctcctagctatgtcggtcgatatgtaagatttaataattaagtcttttatgggaaataattaaagttg

SEQ ID NO: 63 - protein, 71 aa, Triticum aestivum
  REGION 1..71: note = Ceres Clone ID no. 897331
  REGION 11..71: note = Pfam Name: potato_inhibit Pfam Description: Potato inhibitor I family
  REGION 1..71: note = Bit score of 131.7 for HMM based on sequences of Figure 12
  REGION 1..71: note = Functional Homolog Of SEQ ID NO. 26
MSSSDDTCGKKASWPELVGKSIEEAKKTIMKDRPDVKNIEVFPVGTPVTGDFRPDRVRIFVDTVAETPRIG

SEQ ID NO: 64 - DNA, 480 bp, Triticum aestivum
  misc_feature 1..480: note = Ceres Clone ID no. 617775
  misc_feature 1..480: note = Encodes the peptide sequence at SEQ ID NO. 65
  source 1..480: mol_type = other DNA
aaaatcaagtagtacaacacaaagctctctatcaggaattcgatcaggatcatcgtcgtccatcagtcgagacgtacgtggttcagttcaacaggtcctcagtacgagaatgagctcctcggacgacacctgcggcaagaaggcgtcgtggccggagctggttgggaagtccatcgaggaggccaagaagatcatcatgaaggacaggccggatgtgaagatcatcgaggtcttcccggtcggcaccgccgtgaccggggacttcaggcccgaccgtgtccgcatcttcgtcgacaccgttgcggagatcccccgcattggctagcttttgttgatgccccaccgttttatgtgtgtgtgtctgtatgtgttatgttcctgaataaaccatagctagtgagtagtgaccatgtatgcatactactcctagctatgtcggtcgctctgtaagaattaaaataatcattaaacttttttatg

SEQ ID NO: 65 - protein, 71 aa, Triticum aestivum
  REGION 1..71: note = Ceres Clone ID no. 617775
  REGION 11..71: note = Pfam Name: potato_inhibit Pfam Description: Potato inhibitor I family
  REGION 1..71: note = Bit score of 134.9 for HMM based on sequences of Figure 12
  REGION 1..71: note = Functional Homolog Of SEQ ID NO. 26
MSSSDDTCGKKASWPELVGKSIEEAKKIIMKDRPDVKIIEVFPVGTAVTGDFRPDRVRIFVDTVAEIPRIG

SEQ ID NO: 66 - protein, 72 aa, Hordeum vulgare
  REGION 1..72: note = Public GI ID no. 20513866
  REGION 13..72: note = Pfam Name: potato_inhibit Pfam Description: Potato inhibitor I family
  REGION 1..72: note = Bit score of 148.2 for HMM based on sequences of Figure 12
  REGION 1..72: note = Functional Homolog Of SEQ ID NO. 26
MSSSGAAVGECKKTSWPEVVGLTIKEAKEIILKDKPEADIVVVPVGSAVTEDFRPNRVRIFVGTVVETPHVG

SEQ ID NO: 67 - DNA, 222 bp, Sorghum bicolor
  misc_feature 1..222: note = Ceres Annot ID no. 8724387
  misc_feature 1..222: note = Encodes the peptide sequence at SEQ ID NO. 68
  source 1..222: mol_type = other DNA
atgagctcctcggcggaagcggagcgcggcggcgccaagaagcagtcatggccagaggtggtcggactgagcgtggaggaggccaagaaggttatcctcaaagataagcccgatgcagacattttcgtgctgcccgtcggatcgccggtgaccagggatttccgtccgaaccgtgtccgcatcttcgtcgacaccgtcgccgagacgccccgtgtcggctag

SEQ ID NO: 68 - protein, 73 aa, Sorghum bicolor
  REGION 1..73: note = Ceres Annot ID no. 8724387
  REGION 14..73: note = Pfam Name: potato_inhibit Pfam Description: Potato inhibitor I family
  REGION 1..73: note = Bit score of 153.3 for HMM based on sequences of Figure 12
  REGION 1..73: note = Functional Homolog Of SEQ ID NO. 26
MSSSAEAERGGAKKQSWPEVVGLSVEEAKKVILKDKPDADIFVLPVGSPVTRDFRPNRVRIFVDTVAETPRVG

SEQ ID NO: 69 - DNA, 476 bp, Panicum virgatum
  misc_feature 1..476: note = Ceres Clone ID no. 1804405
  misc_feature 1..476: note = Encodes the peptide sequence at SEQ ID NO. 70
  source 1..476: mol_type = other DNA
agtacaggaagcacaagaaagccacttctagccatcaacaacgacttcttcttcaccatcatcgtcacctaactcagacagcatcgatcgatccgcaggtattagcgactgaagaagaagaagatgagctcctccgcggaaccagctgtgtgcggcggcggcggcaagatcacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtttgaataataatggatgtgtgttctttccctataaatcaaataaataagcaagggatgtgtg

SEQ ID NO: 70 - protein, 75 aa, Panicum virgatum
  REGION 1..75: note = Ceres Clone ID no. 1804405
  REGION 17..75: note = Pfam Name: potato_inhibit Pfam Description: Potato inhibitor I family
  REGION 1..75: note = Bit score of 151.7 for HMM based on sequences of Figure 12
  REGION 1..75: note = Functional Homolog Of SEQ ID NO. 26
MSSSAEPAVCGGGGKITSWPEVVGMSIEEAKKVILKDKPDADIQVLPVGTPVTKDFRPNRVRIFVNTVAETPHVG

SEQ ID NO: 71 - protein, 74 aa, Zea perennis
  REGION 1..74: note = Public GI ID no. 48093396
  REGION 15..74: note = Pfam Name: potato_inhibit Pfam Description: Potato inhibitor I family
  REGION 1..74: note = Bit score of 155.3 for HMM based on sequences of Figure 12
  REGION 1..74: note = Functional Homolog Of SEQ ID NO. 26
MSSTECGGGGGGGAKTSWPEVVGLSVEEAKKVILKDKPDADIVVLPVGSVVTADYRPNRVRIFVDIVAQTPHVG

SEQ ID NO: 72 - protein, 89 aa, Oryza sativa
  REGION 1..89: note = Public GI ID no. 108862602
  REGION 30..89: note = Pfam Name: potato_inhibit Pfam Description: Potato inhibitor I family
  REGION 1..89: note = Bit score of 140.2 for HMM based on sequences of Figure 12
  REGION 1..89: note = Functional Homolog Of SEQ ID NO. 26
  source 1..89: note = Oryza sativa subsp. japonica
MNSTSHFVAISFFHHQLDQTRRGKMSSSAKTSWPEVVGLSIEEAKKVILKDKPDADIVVLPFGTAVPEDFRFNRVRIFVDTVAETPRVG

SEQ ID NO: 73 - protein, 65 aa, Oryza sativa
  REGION 1..65: note = Public GI ID no. 115488400
  REGION 6..65: note = Pfam Name: potato_inhibit Pfam Description: Potato inhibitor I family
  REGION 1..65: note = Bit score of 140.2 for HMM based on sequences of Figure 12
  REGION 1..65: note = Functional Homolog Of SEQ ID NO. 26
  source 1..65: note = Oryza sativa subsp. japonica
MSSSAKTSWPEVVGLSIEEAKKVILKDKPDADIVVLPFGTAVPEDFRFNRVRIFVDTVAETPRVG

SEQ ID NO: 74 - DNA, 438 bp, Triticum aestivum
  misc_feature 1..438: note = Ceres Clone ID no. 759663
  misc_feature 1..438: note = Encodes the peptide sequence at SEQ ID NO. 75
  source 1..438: mol_type = other DNA
gaatcaagtcccacacagcgcaactcactagccggtcaatcatcgaatatcatcggccgtccgcgcgtccatcagtcggagaagaccgtccatcaatcgttatcaaccagtgctgcgaagatgagttcctccgacgacctcgccggtggaaagaagacttcgtggccggaggtggtcgggctgaccatcaaggaggccaaggagatcatcctgaaggacaagcccgacgccgacattgtcatggtgccggtcggctccgccgtgaccgaggacttgaggcccaaccgtgtccgcatcttcgtgggcaccgtcgccgagaccccccacgttggataggtggatagctcttgctggcttgctgtggcctgcatacatacatgctggctcacgaataaatgaatatggagaaataaagaagtatgcaagtcatgtgtgctt

SEQ ID NO: 75 - protein, 71 aa, Triticum aestivum
  REGION 1..71: note = Ceres Clone ID no. 759663
  REGION 12..71: note = Pfam Name: potato_inhibit Pfam Description: Potato inhibitor I family
  REGION 1..71: note = Bit score of 161.9 for HMM based on sequences of Figure 12
  REGION 1..71: note = Functional Homolog Of SEQ ID NO. 26
MSSSDDLAGGKKTSWPEVVGLTIKEAKEIILKDKPDADIVMVPVGSAVTEDLRPNRVRIFVGTVAETPHVG

SEQ ID NO: 76 - DNA, 651 bp, Panicum virgatum
  misc_feature 1..651: note = Ceres Clone ID no. 1801827
  misc_feature 1..651: note = Encodes the peptide sequence at SEQ ID NO. 77
  source 1..651: mol_type = other DNA
agtacaagaagcacaagaaaaaacacttgtagccatcaacttcttcttcttcttcttcttcaccgtcatcaactcatcatcagctcagaccgtgagtggaatcccttgccttaatttttttacagtttctttgtacacatatatagctacatgtttttgactgcaaataaagcatcgatcgatccgcagctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaatcagggttagaaatatcggccgcaatttcacgatatacccgatatatcgggtttatcggtggggtctgatatttttttttatcggccgaaattgatttaatgaatatttttt

SEQ ID NO: 77 - protein, 74 aa, Panicum virgatum
  REGION 1..74: note = Ceres Clone ID no. 1801827
  REGION 15..74: note = Pfam Name: potato_inhibit Pfam Description: Potato inhibitor I family
  REGION 1..74: note = Bit score of 160.7 for HMM based on sequences of Figure 12
  REGION 1..74: note = Functional Homolog Of SEQ ID NO. 26
MSSSAEAADQCGGGKTSWPEVVGMSIEEAKKVILKDKPDADIHVLPVGTPVTRDFRPNRVRIFVGTVAQTPHVG

SEQ ID NO: 78 - protein, 75 aa, Tripsacum dactyloides
  REGION 1..75: note = Public GI ID no. 48093418
  REGION 16..75: note = Pfam Name: potato_inhibit Pfam Description: Potato inhibitor I family
  REGION 1..75: note = Bit score of 155.5 for HMM based on sequences of Figure 12
  REGION 1..75: note = Functional Homolog Of SEQ ID NO. 26
MSSTAAAAPECGGGAKTSWPEVVGLSVEEAKKVILKDKPDADIVVLPVGSVVTADYRPDRVRIFVDIVAQTPHIG

SEQ ID NO: 79 - protein, 72 aa, Zea diploperennis
  REGION 1..72: note = Public GI ID no. 48093360
  REGION 13..72: note = Pfam Name: potato_inhibit Pfam Description: Potato inhibitor I family
  REGION 1..72: note = Bit score of 154.7 for HMM based on sequences of Figure 12
  REGION 1..72: note = Functional Homolog Of SEQ ID NO. 26
MSSTECGGGGGAKTSWPEVVGLSVEEAKKVILKDKPDADIVVLPVGSVVTADYRPNRVRIFVDIVAQTPHVG

SEQ ID NO: 80 - DNA, 489 bp, Zea mays
  misc_feature 1..489: note = Ceres Clone ID no. 1457620
  misc_feature 1..489: note = Encodes the peptide sequence at SEQ ID NO. 81
  source 1..489: mol_type = other DNA
acacaaagaagctccataattaattattgccctttcaattcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaataaattgctagtaaaaataatggcatcgtcggtatgcatgaataaaatgtatcagaatgttcatcctttcacgattggatatatgaaaattggatatatgaaaatgtgctcagttgtttggtttc

SEQ ID NO: 81 - protein, 71 aa, Zea mays
  REGION 1..71: note = Ceres Clone ID no. 1457620
  REGION 12..71: note = Pfam Name: potato_inhibit Pfam Description: Potato inhibitor I family
  REGION 1..71: note = Bit score of 141.1 for HMM based on sequences of Figure 12
  REGION 1..71: note = Functional Homolog Of SEQ ID NO. 26
MSSTGGGDDGAKKSWPEVVGLSLEEAKRVILCDKPDADIVVLPVGTPVTMDFRPNRVRIFVDTVAEAPHIG

SEQ ID NO: 82 - protein, 72 aa, Zea diploperennis
  REGION 1..72: note = Public GI ID no. 48093370
  REGION 13..72: note = Pfam Name: potato_inhibit Pfam Description: Potato inhibitor I family
  REGION 1..72: note = Bit score of 152.7 for HMM based on sequences of Figure 12
  REGION 1..72: note = Functional Homolog Of SEQ ID NO. 26
MSSTECGGGGGAKTSWPEVVGLSVEEAKKVILKDKPDADIVVLPIGSVVTADYRPNRVRIFVDIVAQTPHVG

SEQ ID NO: 83 - DNA, 430 bp, Triticum aestivum
  misc_feature 1..430: note = Ceres Clone ID no. 639183
  misc_feature 1..430: note = Encodes the peptide sequence at SEQ ID NO. 84
  source 1..430: mol_type = other DNA
aactaaagtctcacgcacagcgcaagtccaacttgctagcctgtccatcatcgaatatcatcggccgtccgcgcgtccatagctgggagaagaccgtccattaatcgttctcaaccagtgctacgaagatgagttcctccgacgacctcgccggtggaaagaagacttcgtggccggaggtggtcgggctgaccatcaaggaggccaaggagatcatcctcaaggacaagcccgacgccgacatcgtcgtggtgccggtcggctccgccgtgaccgaggacttgaggcccaaccgtgtccgcatcttcgtgggcaccgtcaccgagaccccccacgttggataggtggatagctcttgctggcttgctgtggcctgcatacatagatgctggctcacaagtaagtgaataatngagatataaagaagtat

SEQ ID NO: 84 - protein, 71 aa, Triticum aestivum
  REGION 1..71: note = Ceres Clone ID no. 639183
  REGION 12..71: note = Pfam Name: potato_inhibit Pfam Description: Potato inhibitor I family
  REGION 1..71: note = Bit score of 159.6 for HMM based on sequences of Figure 12
  REGION 1..71: note = Functional Homolog Of SEQ ID NO. 26
MSSSDDLAGGKKTSWPEVVGLTIKEAKEIILKDKPDADIVVVPVGSAVTEDLRPNRVRIFVGTVTETPHVG

SEQ ID NO: 85 - DNA, 460 bp, Zea mays
  misc_feature 1..460: note = Ceres Clone ID no. 1453564
  misc_feature 1..460: note = Encodes the peptide sequence at SEQ ID NO. 86
  source 1..460: mol_type = other DNA
acacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcatcgacaccgtcgcggaggcaccccacatcggctgaggtttaaatctacaaaatgaatgactcggacatgccatgcgtacctgtccgtcgcccaataatggatgtgtgtgtgcttcgatcgtccctataagttgctagtaaagataatggcatcgtcgttctgcatgaataacacgtatcagaaagtggaaactggctcgacttctaaacatcggagtc

SEQ ID NO: 86 - protein, 71 aa, Zea mays
  REGION 1..71: note = Ceres Clone ID no. 1453564
  REGION 12..71: note = Pfam Name: potato_inhibit Pfam Description: Potato inhibitor I family
  REGION 1..71: note = Bit score of 138.9 for HMM based on sequences of Figure 12
  REGION 1..71: note = Functional Homolog Of SEQ ID NO. 26
MSSTGGGDDGAKKSWPEVVGLSLEEAKRVILCDKPDADIVVLPVGTPVTMDFRPNRVRIFIDTVAEAPHIG

SEQ ID NO: 87 - DNA, 443 bp, Zea mays
  misc_feature 1..443: note = Ceres Clone ID no. 1531954
  misc_feature 1..443: note = Encodes the peptide sequence at SEQ ID NO. 88
  source 1..443: mol_type = other DNA
atatatatccaacaaccagcagtgcaacaagcaagatttacctgcccatcgatcatatcgtcaactggtccggcagttcgcgacaccatgagctccaccgagtgcggcggcggcggcggcggcaccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgagtccgcatcttcgtcgacatcgtcgcccagacgccccacatcggctgataatatataagctaacccctatttcctttccttgccccagaacttgaaataaatatatatacgatgaaataacgcgggcatgcctaataatggatgtgtgaattctcactctcgaagaacccaattcgccctat

SEQ ID NO: 88 - protein, 73 aa, Zea mays
  REGION 1..73: note = Ceres Clone ID no. 1531954
  REGION 14..73: note = Pfam Name: potato_inhibit Pfam Description: Potato inhibitor I family
  REGION 1..73: note = Bit score of 154.9 for HMM based on sequences of Figure 12
  REGION 1..73: note = Functional Homolog Of SEQ ID NO. 26
MSSTECGGGGGGTKTSWPEVVGLSVEDAKKVILKDKPDADIVVLPVGSVVTADYRPNRVRIFVDIVAQTPHIG

SEQ ID NO: 89 - DNA, 583 bp, Zea mays
  misc_feature 1..583: note = Ceres Clone ID no. 1460371
  misc_feature 1..583: note = Encodes the peptide sequence at SEQ ID NO. 90
  source 1..583: mol_type = other DNA
acacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaaatctataaaatgaataactcggacatgtcatgcgtgcatgtccgtcgccgaataatggatgtgtgtgcttcgttccaataaattgctagtaaaaataatggcatcgtcggtatgcatgaataaaatgtatcagaatgttcatcctttcacgattggatatatgaaaatgtgctcagttgtttggtttccaacttgttttctataaggtcgatgaactggaacgcaggctcaaataatgatggaatctgcacaatatagataggttaacgacttagagcatgtacatcttattaattaaatat

SEQ ID NO: 90 - protein, 70 aa, Zea mays
  REGION 1..70: note = Ceres Clone ID no. 1460371
  REGION 11..70: note = Pfam Name: potato_inhibit Pfam Description: Potato inhibitor I family
  REGION 1..70: note = Bit score of 138.0 for HMM based on sequences of Figure 12
  REGION 1..70: note = Functional Homolog Of SEQ ID NO. 26
MSSTGGDDGAKKSWPEVVGLSLEEAKRVILCDKPDADIVVLPVGTPVTMDFRPNRVRIFVDTVAEAPHIG

SEQ ID NO: 91 - DNA, 356 bp, Zea mays
  misc_feature 1..356: note = Ceres Clone ID no. 1627479
  misc_feature 1..356: note = Encodes the peptide sequence at SEQ ID NO. 92
  source 1..356: mol_type = other DNA
atatatccaacaaccagcagtgcaacaagcaagatttacctgcccatataattcacatgccagatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttcc

SEQ ID NO: 92 - protein, 73 aa, Zea mays
  REGION 1..73: note = Ceres Clone ID no. 1627479
  REGION 14..73: note = Pfam Name: potato_inhibit Pfam Description: Potato inhibitor I family
  REGION 1..73: note = Bit score of 155.9 for HMM based on sequences of Figure 12
  REGION 1..73: note = Functional Homolog Of SEQ ID NO. 26
MSSTECGGGGGGAKTSWPEVVGLSVEDAKKVILKDKPDADIVVLPVGSVVTADYRPNRVRIFVDIVAQTPHIG

SEQ ID NO: 93 - DNA, 560 bp, Zea mays
  misc_feature 1..560: note = Ceres Clone ID no. 992630
  misc_feature 1..560: note = Encodes the peptide sequence at SEQ ID NO. 94
  source 1..560: mol_type = other DNA
agtctcacatagcatagccatcttcttcgtcgacaagcaggggagttaggtctcacatgcatgcttcatcacattgttgactgcataacgaaacacatcgtcgtcggatcggagatgatgagttccgtcgtcgtggatgctgctgctaccagcagcagcgagaagaagacgtcgtggccggaggtggtgggcatgtccatcaaggaggcgacggagactattctcaaggacatgcccaacgcgtacatccaggtgctgcctgttgggtcgcccgtgacgctggaccttcgccccgaccgcgtccgtatcttcgttgacaccgtcgccatgactccgacagttgggtgatacataccaaatgcaataaacaaaccctactttttattttatgtttccagttaataataaaccaggccttagcttcttggttgtccttccttggttggtgttagcttctaagctactagtacaccattaaaaaaaggaggacctcatgtatggctaccgtgaaaaatgtgatcttgatggaataatatatcataaataagcaattaatgatg

SEQ ID NO: 94 - protein, 76 aa, Zea mays
  REGION 1..76: note = Ceres Clone ID no. 992630
  REGION 17..76: note = Pfam Name: potato_inhibit Pfam Description: Potato inhibitor I family
  REGION 1..76: note = Bit score of 138.6 for HMM based on sequences of Figure 12
  REGION 1..76: note = Functional Homolog Of SEQ ID NO. 26
MSSVVVDAAATSSSEKKTSWPEVVGMSIKEATETILKDMPNAYIQVLPVGSPVTLDLRPDRVRIFVDTVAMTPTVG

SEQ ID NO: 95 - DNA, 518 bp, Triticum aestivum
  misc_feature 1..518: note = Ceres Clone ID no. 685480
  misc_feature 1..518: note = Encodes the peptide sequence at SEQ ID NO. 96
  source 1..518: mol_type = other DNA
atcacacagctactagctagcacagcagcattgacttgggatttggggatcacatcacacaagaaaatattactccatgggaggccaaaagggtcctgctgcgatcatggtgggtgtgctcctcatactggggctggccactgcggcgatgagctcctcggagaaggtggccaccggcgagaagacgtcgtggccggaggtggtggggctatgcgcggaggaggccaagaagatcatcctcaaggacaagcccgatgccaacatcgtcgttctccccgccggctcgatggtcaccatggactacgatcccctgcgcgtccgcatcttcgtcgataccgtcgccgaggccccccacaccggctagctaagcttggtacctacacggttacacagaagtgactattaatgtcaagggacatggaagaataatttcatataccccccatatccatgcatggatgtcacgggcatatgtgtgctagctccttaatttgcattgtcactttagttttgcgccc

SEQ ID NO: 96 - protein, 95 aa, Triticum aestivum
  REGION 1..95: note = Ceres Clone ID no. 685480
  REGION 36..95: note = Pfam Name: potato_inhibit Pfam Description: Potato inhibitor I family
  REGION 1..95: note = Bit score of 132.9 for HMM based on sequences of Figure 12
  REGION 1..95: note = Functional Homolog Of SEQ ID NO. 26
MGGQKGPAAIMVGVLLILGLATAAMSSSEKVATGEKTSWPEVVGLCAEEAKKIILKDKPDANIVVLPAGSMVTMDYDPLRVRIFVDTVAEAPHTG

SEQ ID NO: 97 - protein, 73 aa, Zea mays
  REGION 1..73: note = Public GI ID no. 75994159
  REGION 14..73: note = Pfam Name: potato_inhibit Pfam Description: Potato inhibitor I family
  REGION 1..73: note = Bit score of 154.9 for HMM based on sequences of Figure 12
  REGION 1..73: note = Functional Homolog Of SEQ ID NO. 26
  source 1..73: note = Zea mays subsp. parviglumis
MSSTECGGGGGGAKTSWPEVVGLSVEDAKKVILKDKPDADIVVLPVGSVVTADYRPNRVRIFVDIVAQTPHVG

SEQ ID NO: 98 - DNA, 222 bp, Sorghum bicolor
  misc_feature 1..222: note = Ceres Annot ID no. 8724380
  misc_feature 1..222: note = Encodes the peptide sequence at SEQ ID NO. 99
  source 1..222: mol_type = other DNA
atgagctccacggcggcggcaccagagagcggcggtgccaagacatcgtggccggagttggtggggctcaacgtggaggaagccaagaaggtgatcctcaaggacaagcctgacgccgacattgtcgtgctgcccgtcggctcgccggtgaccagggattatcgccccaaccgcgtccgcatcttcgtcgacatcgtcgccgaggcaccccatgtcggctga

SEQ ID NO: 99 - protein, 73 aa, Sorghum bicolor
  REGION 1..73: note = Ceres Annot ID no. 8724380
  REGION 14..73: note = Pfam Name: potato_inhibit Pfam Description: Potato inhibitor I family
  REGION 1..73: note = Bit score of 147.2 for HMM based on sequences of Figure 12
  REGION 1..73: note = Functional Homolog Of SEQ ID NO. 26
MSSTAAAPESGGAKTSWPELVGLNVEEAKKVILKDKPDADIVVLPVGSPVTRDYRPNRVRIFVDIVAEAPHVG

SEQ ID NO: 100 - protein, 71 aa, Zea diploperennis
  REGION 1..71: note = Public GI ID no. 48093378
  REGION 12..71: note = Pfam Name: potato_inhibit Pfam Description: Potato inhibitor I family
  REGION 1..71: note = Bit score of 153.3 for HMM based on sequences of Figure 12
  REGION 1..71: note = Functional Homolog Of SEQ ID NO. 26
MSSTECGGGGAKTSWPEVVGLSVEEAKKVILKDKPDADIVVLPVGSVVTADYRPNRVRIFVDIVAQTPHVG

SEQ ID NO: 101 - protein, 70 aa, Zea mays
  REGION 1..70: note = Public GI ID no. 75994143
  REGION 11..70: note = Pfam Name: potato_inhibit Pfam Description: Potato inhibitor I family
  REGION 1..70: note = Bit score of 150.5 for HMM based on sequences of Figure 12
  REGION 1..70: note = Functional Homolog Of SEQ ID NO. 26
  source 1..70: note = Zea mays subsp. parviglumis
MSSTECGGGAKTSWPEVVGLSVEDAKKVILKDKPDADIVVLPVGSVVTADYRPNRVRIFVDIVAQTPHIG

SEQ ID NO: 102 - protein, 71 aa, Zea mays
  REGION 1..71: note = Public GI ID no. 75994153
  REGION 12..71: note = Pfam Name: potato_inhibit Pfam Description: Potato inhibitor I family
  REGION 1..71: note = Bit score of 151.8 for HMM based on sequences of Figure 12
  REGION 1..71: note = Functional Homolog Of SEQ ID NO. 26
  source 1..71: note = Zea mays subsp. parviglumis
MSSTECGGGGAKTSWPEVVGLSVEDAKKVILKDKPDADIVVLPVGSVVTADYRPNRVRIFVDIVAQTPHIG

SEQ ID NO: 103 - DNA, 225 bp, Sorghum bicolor
  misc_feature 1..225: note = Ceres Annot ID no. 8724381
  misc_feature 1..225: note = Encodes the peptide sequence at SEQ ID NO. 104
  source 1..225: mol_type = other DNA
atgagctccacggcgacggcggcaccagagtgcggcggcgccaagacgtcgtggccggaggtggtcgggaagagcgtggaggaagccaagaaagtgatcctcaaggacaagcccgacgccgacatcgtcgtgctgcccgtcggctcgccggtgaccatggattaccgcaccaaccgcgtccggatcttcgtcgacacagtcgcccagacgccccatgtcggctga

SEQ ID NO: 104 - protein, 74 aa, Sorghum bicolor
  REGION 1..74: note = Ceres Annot ID no. 8724381
  REGION 15..74: note = Pfam Name: potato_inhibit Pfam Description: Potato inhibitor I family
  REGION 1..74: note = Bit score of 154.2 for HMM based on sequences of Figure 12
  REGION 1..74: note = Functional Homolog Of SEQ ID NO. 26
MSSTATAAPECGGAKTSWPEVVGKSVEEAKKVILKDKPDADIVVLPVGSPVTMDYRTNRVRIFVDTVAQTPHVG

SEQ ID NO: 105 - protein, 71 aa, Zea mays
  REGION 1..71: note = Public GI ID no. 75994157
  REGION 12..71: note = Pfam Name: potato_inhibit Pfam Description: Potato inhibitor I family
  REGION 1..71: note = Bit score of 150.4 for HMM based on sequences of Figure 12
  REGION 1..71: note = Functional Homolog Of SEQ ID NO. 26
  source 1..71: note = Zea mays subsp. parviglumis
MSSTECGGGGVKTSWPEVVGLSVEDAKKVILKDKPDADIVVLPVGSVVTADYRPNRVRIFVDIVAQTPHIG

SEQ ID NO: 106 - DNA, 452 bp, Triticum aestivum
  misc_feature 1..452: note = Ceres Clone ID no. 730301
  misc_feature 1..452: note = Encodes the peptide sequence at SEQ ID NO. 107
  source 1..452: mol_type = other DNA
aagtactcctaccggtcaagttcagactcgcatagtcgaacatgagctacggcgagagcatcgccgccggatgcctcgccggggaggagaagaagacgtcatggccggagttagtgggaaagtccatcgaggaggctagggagatcatcctcaaggacatgcctgatgcggacatcgtcgttgtccctactggctccgcggtaaccgaggacttgaggagcaaccgtgtccgcatcttcgtcgacactgtcgcgaccactcctcacattggctagctagctagctagctttgctcgctgggagcgatgtgcatgcggcaggcatcacgtgtgctgatgaccaagtaatagtttcaataatggatgaataagtacatgctgaccaccaccatgttacttatgaatcaacttgcttttcagctgtctaggttgttgaccgatgtgctcgactag

SEQ ID NO: 107 - protein, 77 aa, Triticum aestivum
  REGION 1..77: note = Ceres Clone ID no. 730301
  REGION 18..77: note = Pfam Name: potato_inhibit Pfam Description: Potato inhibitor I family
  REGION 1..77: note = Bit score of 141.6 for HMM based on sequences of Figure 12
  REGION 1..77: note = Functional Homolog Of SEQ ID NO. 26
MSYGESIAAGCLAGEEKKTSWPELVGKSIEEAREIILKDMPDADIVVVPTGSAVTEDLRSNRVRIFVDTVATTPHIG

SEQ ID NO: 108 - DNA, 222 bp, Sorghum bicolor
  misc_feature 1..222: note = Ceres Annot ID no. 8724388
  misc_feature 1..222: note = Encodes the peptide sequence at SEQ ID NO. 109
  source 1..222: mol_type = other DNA
atgagttccattgtcatggatgttaccagcggcgagaagaagacatcatggcccgaggtgctgggcatgtccatcaaggaggcgacggagatcattctgaaagacatgcccaacgcgtacattcaggtgctgcctgttggttcacctgtgaccctggacattcgccccgatcgcgtccgcatcttcgttgataccgtcgccaagactccgacagttggctga

SEQ ID NO: 109 - protein, 73 aa, Sorghum bicolor
  REGION 1..73: note = Ceres Annot ID no. 8724388
  REGION 14..73: note = Pfam Name: potato_inhibit Pfam Description: Potato inhibitor I family
  REGION 1..73: note = Bit score of 141.2 for HMM based on sequences of Figure 12
  REGION 1..73: note = Functional Homolog Of SEQ ID NO. 26
MSSIVMDVTSGEKKTSWPEVLGMSIKEATEIILKDMPNAYIQVLPVGSPVTLDIRPDRVRIFVDTVAKTPTVG

SEQ ID NO: 110 - DNA, 489 bp, Panicum virgatum
  misc_feature 1..489: note = Ceres Clone ID no. 1764605
  misc_feature 1..489: note = Encodes the peptide sequence at SEQ ID NO. 111
  source 1..489: mol_type = other DNA
acatgcgtacaagcagagaaccactcggccacggagatttctcttgccccttcctcccctctctcctccctccccgaatcacgcgcagtcccatccggcaccagccgccatggcaagaaccactccgttcggtctcgccgtcgcggcggcgctcgtcttcgccgtcgccatgccggccctcgccgccgcgcaggcccccgcgccggcgcccacaagcgacggcacgtcgattgaccagggcatcgcctacctcctgatgatcgtcgccctcgtgctcacctacctcatccaccctctcgacgcctcctccccgtacaagctcttctgagagcagagcagaaatcttttttccttccttgttttgatagggtagtggattatttgagtgagggagaggcatcattggtggtcggtccggtccgtattcatttgtggcgagttctattgggttctgcatgcatgtgtataatattactcctaccttcatgc

SEQ ID NO: 111 - protein, 72 aa, Panicum virgatum
  REGION 1..72: note = Ceres Clone ID no. 1764605
  REGION 4..52: note = Pfam Name: DUF1070 Pfam Description: Protein of unknown function (DUF1070)
  REGION 1..72: note = Bit score of 148.2 for HMM based on sequences of Figure 4
  REGION 1..72: note = Figure 4
MARTTPFGLAVAAALVFAVAMPALAAAQAPAPAPTSDGTSIDQGIAYLLMIVALVLTYLIHPLDASSPYKLF

SEQ ID NO: 112 - DNA, 219 bp, Sorghum bicolor
  misc_feature 1..219: note = Ceres Annot ID no. 8726250
  misc_feature 1..219: note = Encodes the peptide sequence at SEQ ID NO. 113
  source 1..219: mol_type = other DNA
atggcaagaactccactactgggtctcgccatcgccgcggcgctcgtcttcgccgtcgccatgccggccgtcgccgatgcgcaggcccccgccccggcgcccaccagcgacgggacgtcgattgaccagggcattgcgtacctgctgatgatcgtggcgctggtgctcacctacctcatccatcctctggacgcctcctccccatacaggctcttctga

SEQ ID NO: 113 - protein, 72 aa, Sorghum bicolor
  REGION 1..72: note = Ceres Annot ID no. 8726250
  REGION 9..61: note = Pfam Name: DUF1070 Pfam Description: Protein of unknown function (DUF1070)
  REGION 1..72: note = Bit score of 146.9 for HMM based on sequences of Figure 4
  REGION 1..72: note = Functional Homolog Of SEQ ID NO. 111
  REGION 1..72: note = Figure 4
MARTPLLGLAIAAALVFAVAMPAVADAQAPAPAPTSDGTSIDQGIAYLLMIVALVLTYLIHPLDASSPYRLF

SEQ ID NO: 114 - DNA, 506 bp, Triticum aestivum
  misc_feature 1..506: note = Ceres Clone ID no. 899059
  misc_feature 1..506: note = Encodes the peptide sequence at SEQ ID NO. 115
  source 1..506: mol_type = other DNA
aaatataatggcacaagaggcggcagaacgtgaggacaaggcaaagagtcaaggagagagatagaggcatctattctcacaagatacgcggctgccatggcgagaaccctctttggtttcgtcgtcgccgcagcgctcgtcctcgccgtcttcatgccggccctcgccgccgcgcaggcccccgcgccggcgcccaccagcgacgcatcctcggtcgaccaaggcgttgcctattttctgatgatcctggcgctggtgctcacctacctcatccacccgttggacgcctcctccccgtacaagctcttctgagcctgtatatgcgcagaggcttctcattcttttgttcttctttctgttgttcgttggtcgataagctagtggattcttgagagattggttgtgtgagattcgatttggattcattaatttgttgctcttgtactctggtggattcgcacgcacgcgtgcatatttttgttccaatgcttctcaggtctgttgcc

SEQ ID NO: 115 - protein, 71 aa, Triticum aestivum
  REGION 1..71: note = Ceres Clone ID no. 899059
  REGION 8..60: note = Pfam Name: DUF1070 Pfam Description: Protein of unknown function (DUF1070)
  REGION 1..71: note = Bit score of 140.5 for HMM based on sequences of Figure 4
  REGION 1..71: note = Functional Homolog Of SEQ ID NO. 111
  REGION 1..71: note = Figure 4
MARTLFGFVVAAALVLAVFMPALAAAQAPAPAPTSDASSVDQGVAYFLMILALVLTYLIHPLDASSPYKLF

SEQ ID NO: 116 - DNA, 415 bp, Zea mays
  misc_feature 1..415: note = Ceres Clone ID no. 945132
  misc_feature 1..415: note = Encodes the peptide sequence at SEQ ID NO. 117
  source 1..415: mol_type = other DNA
aggcctaggcttttttgaggagcgcggactagggaggacgggacgggggggagagagaggcgcgtgcgttcgtggtcggtgccggtgcgtgcgtgcgtggcgtggtggccgctgccgtacgtgatccgtccaccccctctcctcttccgacgccggcgacagcgggaggtactcccggggaggaatggccgtggcaagggctccgctcggcgcggttgcgatggcggtggccgctctcgtcttcgccatactcatgcccgccgccgctgcggcgcaggcaccggcgcccgcgcccaccagcgacggcacatcaatcgacctggggattgcgtacatccttatgctggttgccctagtgctcacctacctgatccacccgcttgacgcgtcctccccctacaagctcttctgatcc

SEQ ID NO: 117 - protein, 75 aa, Zea mays
  REGION 1..75: note = Ceres Clone ID no. 945132
  REGION 13..64: note = Pfam Name: DUF1070 Pfam Description: Protein of unknown function (DUF1070)
  REGION 1..75: note = Bit score of 144.5 for HMM based on sequences of Figure 4
  REGION 1..75: note = Functional Homolog Of SEQ ID NO. 111
  REGION 1..75: note = Figure 4
MAVARAPLGAVAMAVAALVFAILMPAAAAAQAPAPAPTSDGTSIDLGIAYILMLVALVLTYLIHPLDASSPYKLF

SEQ ID NO: 118 - protein, 67 aa, Oryza sativa
  REGION 1..67: note = Public GI ID no. 115462673
  REGION 4..56: note = Pfam Name: DUF1070 Pfam Description: Protein of unknown function (DUF1070)
  REGION 1..67: note = Bit score of 133.2 for HMM based on sequences of Figure 4
  REGION 1..67: note = Functional Homolog Of SEQ ID NO. 111
  REGION 1..67: note = Figure 4
  source 1..67: note = Oryza sativa subsp. japonica
MARIPFAAIVVAILSFAIAAAAQAPAPSPTSDGTSVDQGIAYLLMIVALVLTYLIHPLDASSAYKLF

SEQ ID NO: 119 - DNA, 589 bp, Arabidopsis thaliana
  misc_feature 1..589: note = Ceres Clone ID no. 16400
  misc_feature 1..589: note = Encodes the peptide sequence at SEQ ID NO. 120
  source 1..589: mol_type = other DNA
cacttcttgctttattcctctcataccgttttctctctctcctccgtcgtctctgcagaatcactctctcgccggagtttttcacctgcagagctctcgattttttctctcgagcatcatcattttcgtcggatcaatcaccaagagatggcgtcgagaaactccgtcaccggattcgcgttgttcagttttgtattcgccgtcatcttatctctcgccggcgctcaatccctggctccagctcctgctcccaccagcgatggaacatcgatagatcaagggatagcgtatttgctaatggtggtggcgttagtgctgacttacctaattcatcctcttgatgcttcttcttcctactccttcttctaatctctctctctctttcttctgtttttttttatttctttgcaacttcttattagtttcttcaatttgccttttttcttcttcttgtggataaaattttcaagagttaatttcatcatcatgttctcgattatgatttctggagattgattgattgatgataatctctactgtttgttcttttttgtttattctcttccatattaaatttattcytcttccc

SEQ ID NO: 120 - protein, 73 aa, Arabidopsis thaliana
  REGION 1..73: note = Ceres Clone ID no. 16400
  REGION 10..62: note = Pfam Name: DUF1070 Pfam Description: Protein of unknown function (DUF1070)
  REGION 1..73: note = Bit score of 136.1 for HMM based on sequences of Figure 4
  REGION 1..73: note = Functional Homolog Of SEQ ID NO. 111
  REGION 1..73: note = Figure 4
MASRNSVTGFALFSFVFAVILSLAGAQSLAPAPAPTSDGTSIDQGIAYLLMVVALVLTYLIHPLDASSSYSFF

SEQ ID NO: 121 - DNA, 477 bp, Musa acuminata
  misc_feature 1..477: note = Ceres Clone ID no. 1712201
  misc_feature 1..477: note = Encodes the peptide sequence at SEQ ID NO. 122
  source 1..477: mol_type = other DNA
atagaggaggaaatcgattcgaagcacattgcctcccgcagatctctctcctcctcctctctgctccgctcagagaaggaagagagagatctcaggtttgtctgtctgttccagtctttttcgaagcggaggaagatcacggccgagatggcggcaatccctaaagttttagtggccgttttggttctcgccttggcgactgttgtgccgtccgtccaggctcaggctcccgccccatcacctaccagcgacggcacatcaatcgaccaggggattgcttatttgctaatgcttgtggccctggtcctcacctacctcatccaccccttggatgcctccccctacaagctcttctaagcctttctaggtttacatttatgtctgtgaggaagggattggtggtttgtcttgcttgtacttgcatgatcatggtgtgggatttggacattttttaatggaactatcatgttgatttag

SEQ ID NO: 122 - protein, 69 aa, Musa acuminata
  REGION 1..69: note = Ceres Clone ID no. 1712201
  REGION 9..59: note = Pfam Name: DUF1070 Pfam Description: Protein of unknown function (DUF1070)
  REGION 1..69: note = Bit score of 134.7 for HMM based on sequences of Figure 4
  REGION 1..69: note = Functional Homolog Of SEQ ID NO. 111
  REGION 1..69: note = Figure 4
MAAIPKVLVAVLVLALATVVPSVQAQAPAPSPTSDGTSIDQGIAYLLMLVALVLTYLIHPLDASPYKLF

SEQ ID NO: 123 - DNA, 231 bp, Populus balsamifera
  misc_feature 1..231: note = Ceres Annot ID no. 1524669
  misc_feature 1..231: note = Encodes the peptide sequence at SEQ ID NO. 124
  source 1..231: mol_type = other DNA
atggcagtttgtgcttcattcaaggcttttattgccgttttggctgttgtttctcttattttggctgttgtctccccttctgttgaggcccagtctcccgctcccgctcctgcacctaccagcgatgggacttcaatcgaccaaggaatcgcatacctgctgatgcttgtggctctggtgctcacatacctgatccacccgctggatgcttcatcctacactttcttttga

SEQ ID NO: 124 - protein, 76 aa, Populus trichocarpa
  REGION 1..76: note = Ceres Annot ID no. 1524669
  REGION 14..66: note = Pfam Name: DUF1070 Pfam Description: Protein of unknown function (DUF1070)
  REGION 1..76: note = Bit score of 137.2 for HMM based on sequences of Figure 4
  REGION 1..76: note = Functional Homolog Of SEQ ID NO. 111
  REGION 1..76: note = Figure 4
MAVCASFKAFIAVLAVVSLILAVVSPSVEAQSPAPAPAPTSDGTSIDQGIAYLLMLVALVLTYLIHPLDASSYTFF

SEQ ID NO: 125 - DNA, 222 bp, Sorghum bicolor
  misc_feature 1..222: note = Ceres Annot ID no. 8672987
  misc_feature 1..222: note = Encodes the peptide sequence at SEQ ID NO. 126
  source 1..222: mol_type = other DNA
atggctgggatgagggctccgctcggcgtggtggcggtggccgccctcgtcgtcgccatcttcatgcccgccgccgccgcggcgcaggcaccggcgcccgcgcccaccagtgacggcacatcaatcgacctggggatcgcgtacatccttatgctggtggccctggtgctcacctacctgatccacccgctggacgcgtcctctccctacaagctcttgtaa

SEQ ID NO: 126 - protein, 73 aa, Sorghum bicolor
  REGION 1..73: note = Ceres Annot ID no. 8672987
  REGION 10..62: note = Pfam Name: DUF1070 Pfam Description: Protein of unknown function (DUF1070)
  REGION 1..73: note = Bit score of 131.5 for HMM based on sequences of Figure 4
  REGION 1..73: note = Functional Homolog Of SEQ ID NO. 111
MAGMRAPLGVVAVAALVVAIFMPAAAAAQAPAPAPTSDGTSIDLGIAYILMLVALVLTYLIHPLDASSPYKLL

SEQ ID NO: 127 - DNA, 467 bp, Triticum aestivum
  misc_feature 1..467: note = Ceres Clone ID no. 1434951
  misc_feature 1..467: note = Encodes the peptide sequence at SEQ ID NO. 128
  source 1..467: mol_type = other DNA
aagcccggagtttgtgggagaggaggatttgtcgagagggagggccgcgattcgttgctcttccttcctcctcctgctcgcctccggtgtgggggtgcgctgcggtgcggtgggcggaggggaggtcgagggatcaggagggcgaatcgagggggcgggaggagctagaaggagaggcggcggaaatggcggcgtggacctccgtcggcctggtggcggtggccgtgctggtcgtcggcatcgcaatgccggcctccgccgccgtgcagccgcccgcgcccgcgccctccagcgacggcacgtcgattgaccagggtatcgcatacgtgctgatgctggtggcccttgtgctcacctacctcatccatccgctggacgcctcctccccatacaggctctttctatctaatcaataattcgggttgcacctgtagaggtagctagcagctatgcgatgatgatgattt

SEQ ID NO: 128 - protein, 76 aa, Triticum aestivum
  REGION 1..76: note = Ceres Clone ID no. 1434951
  REGION 9..61: note = Pfam Name: DUF1070 Pfam Description: Protein of unknown function (DUF1070)
  REGION 1..76: note = Bit score of 127.3 for HMM based on sequences of Figure 4
  REGION 1..76: note = Functional Homolog Of SEQ ID NO. 111
MAAWTSVGLVAVAVLVVGIAMPASAAVQPPAPAPSSDGTSIDQGIAYVLMLVALVLTYLIHPLDASSPYRLFLSNQ

SEQ ID NO: 129 - DNA, 615 bp, Zea mays
  misc_feature 1..615: note = Ceres Clone ID no. 299745
  misc_feature 1..615: note = Encodes the peptide sequence at SEQ ID NO. 130
  source 1..615: mol_type = other DNA
attcagatgcgcagccacgtcgtagcaggcctaggcttttttgaggagcgcggactagggagtagggaggacgggacgggagagagagagagaggcgcgtgcgttcgtggtcggtgccggtgcgtgcgtggcgtggtggccgctgccgtacgtgatccgtccaccccctctcctcttccgacgccggcgacagcgggaggtactcccggggaggaatggccgtggcaagggctccgctcggcgcggttgctgcgatggcggtggccgctctcgtcttcgccatactcatgaccgccgccgctgcggcgcaggcaccggcgcccgcgcccaccagcgacggcacatcaatcgacctggggattgcgtacatccttatgctggttgccctagtgctcacctacctgatccacccgcttgacgcgtcctccccctacaagctcttctgatccctgcgcctttccgtttggtcatgcggttaagggcgcgataggattttgagttaggcaacgtgcttaggtgaggctgggaggtttaggatgatgattgcggtcatctggtcttgcttggtatgatgtattggaggctcgaagctgttggtgttctgattggttttgt

SEQ ID NO: 130 - protein, 76 aa, Zea mays
  REGION 1..76: note = Ceres Clone ID no. 299745
  REGION 14..65: note = Pfam Name: DUF1070 Pfam Description: Protein of unknown function (DUF1070)
  REGION 1..76: note = Bit score of 138.6 for HMM based on sequences of Figure 4
  REGION 1..76: note = Functional Homolog Of SEQ ID NO. 111
MAVARAPLGAVAAMAVAALVFAILMTAAAAAQAPAPAPTSDGTSIDLGIAYILMLVALVLTYLIHPLDASSPYKLF

SEQ ID NO: 131 - DNA, 824 bp, Zea mays
  misc_feature 1..824: note = Ceres Clone ID no. 323696
  misc_feature 1..824: note = Encodes the peptide sequence at SEQ ID NO. 132
  source 1..824: mol_type = other DNA
agagttgatcgggattcctcgtctctggtctgtctgtgctccacctgactgmatgctgccatggccatgggtagtctcgccttcgccacggcgctcgtcttcgtcttcgccatcgccgtgccggccgtcgcggccgccgcgcaggcccccgccccggcgcccaccagcgacgggacgtcgattgaccagggcatcgcgtacctgctgatgatcatggcgctggtgctcacctacctcatccaccctctggacgcctccgccccgtacaagctcttctgagcgagcagattttttctcctccattttttggtaggctttagtggtggtggtgtgggtgtgggtrarattcggtccctattcattgccatgaattacattcggtttcgcgcgcgtgtgtatattattactcctatatgtcttcaggttcatgctttgatgtccattggttgtcgctttgtgttgcatcgtggagacctcgaggagtagttcttgttcagtagtgcgcatctgacctgacctgaccttccacacgcgaagccttgtggtgtgtgttattggggctttcgcatgatctgaattagtcaaaccgttaaggcactatttcctgatagcaatcgagatcatccattcctgatagcaatcgagatcgtccattcctgatagcaatggagatctttctacccttcagaatacatcccaatccgggagttggaaaccgatccggacggccaagtggagaacttacgtgagctgcggctgagtgttatctacaccgttacgagtttttttttttctattataagactcatttacgcttctctctt

SEQ ID NO: 132 - protein, 72 aa, Zea mays
  REGION 1..72: note = Ceres Clone ID no. 323696
  REGION 9..61: note = Pfam Name: DUF1070 Pfam Description: Protein of unknown function (DUF1070)
  REGION 1..72: note = Bit score of 131.6 for HMM based on sequences of Figure 4
  REGION 1..72: note = Functional Homolog Of SEQ ID NO. 111
MAMGSLAFATALVFVFAIAVPAVAAAAQAPAPAPTSDGTSIDQGIAYLLMIMALVLTYLIHPLDASAPYKLF

SEQ ID NO: 133 - protein, 74 aa, Zea mays
  REGION 1..74: note = Public GI ID no. 194695666
  REGION 11..63: note = Pfam Name: DUF1070 Pfam Description: Protein of unknown function (DUF1070)
  REGION 1..74: note = Bit score of 134.3 for HMM based on sequences of Figure 4
  REGION 1..74: note = Functional Homolog Of SEQ ID NO. 111
MAMGSLAFATALVFVFVFAIAVPAVAAAAQAPAPAPTSDGTSIDQGIAYLLMIMALVLTYLIHPLDASAPYKLF

SEQ ID NO: 134 - DNA, 654 bp, Panicum virgatum
  misc_feature 1..654: note = Ceres Clone ID no. 1771257
  misc_feature 1..654: note = Encodes the peptide sequence at SEQ ID NO. 135
  source 1..654: mol_type = other DNA
gagagagagagagaggcgtctgcgtgcgtggtcggtgccggtgcgtggcgtggtggccgtgcggtcccctcttcctctcggcgccggcggacgtgtcggggggaggaatggccgcgccgagggctccgctcggggcggtcgcggtggccgcgctcgtcgtcgccatcttcatgccggccgcggcggcgcaggggccggcgccggctcccaccagcgacggcacatcaatcgacctgggaatcgcgtacatcttgatgctggtggccctggtgctcacctacctgatccacccgctggacgcgtcctctccctacaagctcttctaatccctgttcgttttgtttgttcgtcgatgatgttatgggtctgataggatttttagccatgcaagacgtttaggtgaggtttggagatttagaatgaacgtcaacgtctgatctgatcttggcatgtatggtaagttttttggtggtctgaatgcctgattggttgtatcggattccatgatcttgtgcccagttgtgcttgctgttggccgttgctggattctatttccgctggtcccgcccgggtgctcattgacatgtgctctgccatggatgccgttgcaagttgcaacaccaaacatgtgaaggactgggtcatggctgtgcc

SEQ ID NO: 135 - protein, 72 aa, Panicum virgatum
  REGION 1..72: note = Ceres Clone ID no. 1771257
  REGION 11..61: note = Pfam Name: DUF1070 Pfam Description: Protein of unknown function (DUF1070)
  REGION 1..72: note = Bit score of 130.1 for HMM based on sequences of Figure 4
  REGION 1..72: note = Functional Homolog Of SEQ ID NO. 111
MAAPRAPLGAVAVAALVVAIFMPAAAAQGPAPAPTSDGTSIDLGIAYILMLVALVLTYLIHPLDASSPYKLF

SEQ ID NO: 136 - protein, 73 aa, Oryza sativa
  REGION 1..73: note = Public GI ID no. 115445433
  REGION 12..62: note = Pfam Name: DUF1070 Pfam Description: Protein of unknown function (DUF1070)
  REGION 1..73: note = Bit score of 122.6 for HMM based on sequences of Figure 4
  REGION 1..73: note = Functional Homolog Of SEQ ID NO. 111
  source 1..73: note = Oryza sativa subsp. japonica
MAVAARAPLGVVAVVAVLVVGIFMPAAAQAPAPAPVSDGTSIDLGIAYILMLVALVLTYLIHPLDASSPYKLF

SEQ ID NO: 137 - DNA, 225 bp, Sorghum bicolor
  misc_feature 1..225: note = Ceres Annot ID no. 8667876
  misc_feature 1..225: note = Encodes the peptide sequence at SEQ ID NO. 138
  source 1..225: mol_type = other DNA
atggcgccgatctccagatccacggcggttgtccttgtgatgatggctgtcgtcgtcgccgtgctcgccgccgcggctaacgcccaggcccccgccccagcacccgctaccagtgacggaacaagtgtagaccagggaatcgcctacgtcctgatgctggtggcgcttgtcctcacctacctcatccacccattggacgcctcctccgcctacaagctcttttaa

SEQ ID NO: 138 - protein, 74 aa, Sorghum bicolor
  REGION 1..74: note = Ceres Annot ID no. 8667876
  REGION 12..63: note = Pfam Name: DUF1070 Pfam Description: Protein of unknown function (DUF1070)
  REGION 1..74: note = Bit score of 117.2 for HMM based on sequences of Figure 4
  REGION 1..74: note = Functional Homolog Of SEQ ID NO. 111
MAPISRSTAVVLVMMAVVVAVLAAAANAQAPAPAPATSDGTSVDQGIAYVLMLVALVLTYLIHPLDASSAYKLF

SEQ ID NO: 139 - protein, 69 aa, Oryza sativa
  REGION 1..69: note = Public GI ID no. 115438957
  REGION 8..58: note = Pfam Name: DUF1070 Pfam Description: Protein of unknown function (DUF1070)
  REGION 1..69: note = Bit score of 112.6 for HMM based on sequences of Figure 4
  REGION 1..69: note = Functional Homolog Of SEQ ID NO. 111
  source 1..69: note = Oryza sativa subsp. japonica
MALISRASVLVMAIVAMLATLVNAQAPAPAPTSDGTSVDQGIAYVLMFVALALTYLIHPLDASSAYKLF

SEQ ID NO: 140 - DNA, 370 bp, Brassica napus
  misc_feature 1..370: note = Ceres Clone ID no. 1100814
  misc_feature 1..370: note = Encodes the peptide sequence at SEQ ID NO. 141
  source 1..370: mol_type = other DNA
atacatcatcatcttcttcacaggccttctcatttcatctccgtctctgcagataactctctctctctcgccggatttttcatttcacctgcagagctcacgatcttattcaatggcgtcgagaaactccgtagccggattcgcgttattcacattcgtattcgccgtcttctcgtctctcgccggcgctcaaaccttagctcccgctcctgctcccaccagtgacgggacatcgatagatcaagggatagcgtatttgctaatggtggtggcgctcgtgctcacttacctaatccatcctctcgatgcatcttcttccctcagcttcttctgattttttttttttagtttcattttgagcgcyattatt

SEQ ID NO: 141 - protein, 73 aa, Brassica napus
  REGION 1..73: note = Ceres Clone ID no. 1100814
  REGION 10..62: note = Pfam Name: DUF1070 Pfam Description: Protein of unknown function (DUF1070)
  REGION 1..73: note = Bit score of 128.0 for HMM based on sequences of Figure 4
  REGION 1..73: note = Functional Homolog Of SEQ ID NO. 111
MASRNSVAGFALFTFVFAVFSSLAGAQTLAPAPAPTSDGTSIDQGIAYLLMVVALVLTYLIHPLDASSSLSFF

SEQ ID NO: 142 - DNA, 483 bp, Arabidopsis thaliana
  misc_feature 1..483: note = Ceres Clone ID no. 1029710
  misc_feature 1..483: note = Encodes the peptide sequence at SEQ ID NO. 143
  source 1..483: mol_type = other DNA
aaaggggtttttggttgtccgtgtcgttcgtcgtctctctcgccggacttgttcattcagatttcgtctctctctctctctcgcactcttctttarttttgtcctccgtaaaatcttgagatggcgtcgaggaactccgttgccgtaatcgctttattcgctttcgttttcgccgtcatctctccattcgccggcgctcaatccttagctcctgctccttcccccactagcgacggaacatcgattgatcaaggaatcgcgtatttgctaatggtggtggcgttggtgctgacgtatctcattcatcctcttgatgcatcttcttcctcctacaccttcttctaatctcttgtatatccaatagtatttggatttctaaatttgagagagtttatgagttctttagtgtttcaacttttcctattttcagtgaacacaaacctctttcgctaatattcagaaattagagatatcttttttgtt

SEQ ID NO: 143 - protein, 74 aa, Arabidopsis thaliana
  REGION 1..74: note = Ceres Clone ID no. 1029710
  REGION 10..62: note = Pfam Name: DUF1070 Pfam Description: Protein of unknown function (DUF1070)
  REGION 1..74: note = Bit score of 130.6 for HMM based on sequences of Figure 4
  REGION 1..74: note = Functional Homolog Of SEQ ID NO. 111
MASRNSVAVIALFAFVFAVISPFAGAQSLAPAPSPTSDGTSIDQGIAYLLMVVALVLTYLIHPLDASSSSYTFF

SEQ ID NO: 144 - DNA, 452 bp, Brassica napus
  misc_feature 1..452: note = Ceres Clone ID no. 969326
  misc_feature 1..452: note = Encodes the peptide sequence at SEQ ID NO. 145
  source 1..452: mol_type = other DNA
acttcatcatcatcctcacactgtctctctttcctccttctctatcctgcagatactccggcaaacttcctttttcgtcgtatcaaaacaccrgrgagagagagatggcgtcaaggagttacgtagctggtttcgcgttrttcacatttgttttcgccgtcgtctcttctctcgccggcgctcaatccctagctcccgctcctgctcccaccagtgatggtaagcatcatcatattcaacgatatcacattcccttcttcttctctctagtctctccagatctgaatccgagagtgttttttttgtttaatccagggacatcgatagatcaagggattgcgtatctgctaatggtggtggcattggtgctgacatacctcattcatcctctcgatgcatcctcttcctacagcttcttctgatttgtctcttcatttcatcagttctttttt

SEQ ID NO: 145 - protein, 105 aa, Brassica napus
  REGION 1..105: note = Ceres Clone ID no. 969326
  REGION 10..94: note = Pfam Name: DUF1070 Pfam Description: Protein of unknown function (DUF1070)
  REGION 1..105: note = Bit score of 94.6 for HMM based on sequences of Figure 4
  REGION 1..105: note = Functional Homolog Of SEQ ID NO. 111
  VARIANT 12: note = X can be any amino acid
MASRSYVAGFAXFTFVFAVVSSLAGAQSLAPAPAPTSDGKHHHIQRYHIPFFFSLVSPDLNPRVFFLFNPGTSIDQGIAYLLMVVALVLTYLIHPLDASSSYSFF

SEQ ID NO: 146 - DNA, 660 bp, Zea mays
  misc_feature 1..660: note = Ceres Clone ID no. 100955392
  misc_feature 1..660: note = Encodes the peptide sequence at SEQ ID NO. 147
  source 1..660: mol_type = other DNA
ttctcgtcctgaccccccagagcgagagggaggggcacccagaggagcctgtcgttttgatcggtgtctctgcccccgttcccgcgaggagagaacaacctggagaaaatggcgccgatctccggagccacggcagtccttgtgatggccgtcgtcgccacgctcgccgccgcggctaacgccctggcccccgccccagcacctgctaccagtgacggaacaagtgtagaccagggaatcgcctacgtcctcatgctggtggcgcttgtcctcacctacctcatccacccattggacgcctcctccgcctacaagcagctcttttaaaaccatccgctttgtaatttggcgccaattgagggtgtcattaacggtgttcgattattaatcgatccagtttggccccacaactagaaaaggaaaaaaatgcacacatcttatccttgctacttctaggatcttttcatatgtcttaatttcaatcgagggcgaggccagaagaagccaaattattgcaaatactcgttaagccttgtttagttattttcatttcatttggattaaatgggattgaaagaagttagcaggaattttgacttgctatagatttaaagctacctaatcttgttcaatccacatggattgagattaaatcgaaaa

SEQ ID NO: 147 - protein, 72 aa, Zea mays
  REGION 1..72: note = Ceres Clone ID no. 100955392
  REGION 9..60: note = Pfam Name: DUF1070 Pfam Description: Protein of unknown function (DUF1070)
  REGION 1..72: note = Bit score of 101.8 for HMM based on sequences of Figure 4
  REGION 1..72: note = Functional Homolog Of SEQ ID NO. 111
MAPISGATAVLVMAVVATLAAAANALAPAPAPATSDGTSVDQGIAYVLMLVALVLTYLIHPLDASSAYKQLF

SEQ ID NO: 148 - protein, 75 aa, Vitis vinifera
  REGION 1..75: note = Public GI ID no. 225454450
  REGION 14..65: note = Pfam Name: DUF1070 Pfam Description: Protein of unknown function (DUF1070)
  REGION 1..75: note = Bit score of 114.5 for HMM based on sequences of Figure 4
  REGION 1..75: note = Functional Homolog Of SEQ ID NO. 111
MAGCSRVGIGAPGFFAFLFVVVSASFARAQSSAPAPAPTSDGTAIDQGIAYVLMLVALVLTYLIHPLDASSYSFF

SEQ ID NO: 149 - protein, 73 aa, Picea sitchensis
  REGION 1..73: note = Public GI ID no. 116779724
  REGION 12..63: note = Pfam Name: DUF1070 Pfam Description: Protein of unknown function (DUF1070)
  REGION 1..73: note = Bit score of 102.3 for HMM based on sequences of Figure 4
  REGION 1..73: note = Functional Homolog Of SEQ ID NO. 111
MAFSSLYVTLLVLSVAFLLINLFAPSANAQAPAPAPTSDGTSIDQGIAYVLMFLALALTYLIHPLDAFPYNLF

SEQ ID NO: 150 - DNA, 210 bp, Populus balsamifera
  misc_feature 1..210: note = Ceres Annot ID no. 1447561
  misc_feature 1..210: note = Encodes the peptide sequence at SEQ ID NO. 151
  source 1..210: mol_type = other DNA
atggctggtgtttccagggttgttgcagctgtagttgctcttcttgttgtttttgccatcgttttgcccattgctcaggcccaagctcctgcccctgcccctaccagtgatgggacatcaattgaccaaggcattgcgtatgtgctgatgatggtggcactagcactcacgtacctcattcacgcggcagacttatcccacagcttctga

SEQ ID NO: 151 - protein, 69 aa, Populus trichocarpa
  REGION 1..69: note = Ceres Annot ID no. 1447561
  REGION 11..61: note = Pfam Name: DUF1070 Pfam Description: Protein of unknown function (DUF1070)
  REGION 1..69: note = Bit score of 96.0 for HMM based on sequences of Figure 4
  REGION 1..69: note = Functional Homolog Of SEQ ID NO. 111
MAGVSRVVAAVVALLVVFAIVLPIAQAQAPAPAPTSDGTSIDQGIAYVLMMVALALTYLIHAADLSHSF

SEQ ID NO: 152 - protein, 67 aa, Capsicum annuum
  REGION 1..67: note = Public GI ID no. 20149060
  REGION 5..57: note = Pfam Name: DUF1070 Pfam Description: Protein of unknown function (DUF1070)
  REGION 1..67: note = Bit score of 104.6 for HMM based on sequences of Figure 4
  REGION 1..67: note = Functional Homolog Of SEQ ID NO. 111
MAAVVSMLLAIFSMAFFTVQAQDFAPAPAPTSDGISIDQGIAYVLMLVALVLTYLIHPMDASSYKLF

SEQ ID NO: 153 - protein, 67 aa, Vitis vinifera
  REGION 1..67: note = Public GI ID no. 225462683
  REGION 11..63: note = Pfam Name: DUF1070 Pfam Description: Protein of unknown function (DUF1070)
  REGION 1..67: note = Bit score of 93.9 for HMM based on sequences of Figure 4
  REGION 1..67: note = Functional Homolog Of SEQ ID NO. 111
MAVSRVSLVVVAIIALLYAVVLPSAHAQSLAPAPAPTSDGTAIDQGIACVLMLVALVLTYLIHPLDA

SEQ ID NO: 154 - DNA, 532 bp, Glycine max
  misc_feature 1..532: note = Ceres Clone ID no. 595099
  misc_feature 1..532: note = Encodes the peptide sequence at SEQ ID NO. 155
  source 1..532: mol_type = other DNA
tccaagttgtcctcatttcaagtctgtgttggttatagaaaagcgcccaagttagagctgagtgtgagataataacaatggcatttctcagagcagcttctgaagttttggcaatctatacccttgtctttaccattttttcacctgctgttcttgaagcacagtctctttcccttgcagctgctcctgctccttccagagatggtacttcaatagaccaaggaattgcatacgtattgatggttgtggcgctggtgctcacgtacctcatccacccctttgacgcgtcttcccatcacttctgaattatctgtactaagaaytttgaacatagtattagtagggactggctggggttgaatttattacgtggataaatatcttctattttttttttgctttattctcttcttatccccctcccaattttacatctttcgtttacttgttaacgatagatgattgctagcggaggaaataatgtattaatataaatattttatttatttaaaggtcatgatctattttagat

SEQ ID NO: 155 - protein, 75 aa, Glycine max
  REGION 1..75: note = Ceres Clone ID no. 595099
  REGION 14..66: note = Pfam Name: DUF1070 Pfam Description: Protein of unknown function (DUF1070)
  REGION 1..75: note = Bit score of 93.2 for HMM based on sequences of Figure 4
  REGION 1..75: note = Functional Homolog Of SEQ ID NO. 111
MAFLRAASEVLAIYTLVFTIFSPAVLEAQSLSLAAAPAPSRDGTSIDQGIAYVLMVVALVLTYLIHPFDASSHHF

SEQ ID NO: 156 - DNA, 2373 bp, Panicum virgatum
  misc_feature 1..2373: note = Ceres Clone ID no. 1888614
  misc_feature 1..2373: note = Encodes the peptide sequence at SEQ ID NO. 157
  source 1..2373: mol_type = other DNA
acgcctcacaatccactggagcagtctgccacccaccccctccacctcgcctggcctccactctggtcagacgctatgtatcaccgatacgcgatacgggtacggcgatatggatatggtgatatgtgagtttaaaaaacgatatagtggtagtatagagagtatcgaagtatggaagtatcgaatacggctgggttagcgaagtatcggtgattcgtataggtcagaagcgccgcacatagataccggggcggcggcacacgcaagaggggcctggccaagtagcctgaccgcttcttgctggctcctcctgtgctccgtttccttttctgctcccgggctccctctcctcgagttctcgcacgcctctcttcctcttgggttgggtccgtccagcaagtggagaaaggggcagggatgaagtccggggagcggccgaagctggtgcggggcctccggcaggagtcgcggcggttccggctgctggtcatcgtcgtcggcttcttcctcgtctccctcaccttcgtcgtcatctccaagcccgacgccatcctcttcagcctgaacggcaagctgccggtggagcaggcgccgacgtccatcctgatcaagcagaaggtcgactcgccgcccgccacctcccggaagactgccaccgacgctctcccaggtggagatcctagagtggtcgacgacgaagccgatgtgagaccaaaaggtaccaaacgcgaggaggaggagagccgggtgctgagcgagcccgacccgaccagcgggatgacggagctgaccgccaacaaggacgggggcggccgtaaatccgacgaggagacgttaggcggcgaggggaaagggaagcaggatggggaggagcgtgggcacgcggcggagaagcacaaagtcacgctcccaaccgtttccaattacaccattcatgactccgaggacaccgaaaatggcaagcaagacgacggtacaggttctgacctgcagggaagcaagcccctgtgtgatttctcaaactttagagcaaatgtgtgcgagatgcgtggtgatgttagggttcacccaaacgctacctcaatcatgtttatggagcctgccggttcgcagagagatgagctctggaagatcaagccataccctcggaagggggacgagttctgcctcagccatatcactgagctgacagtgaaatcaagcaaagtggccccagagtgcaccaagtaccacgacgtgcctgctgtgatcttttcactgacaggatacacggggaacctgttccatgatttcacggacgtgatggtcccccttttcacgaccgcaagcgagttcaatggtgaagttcagttcctcataaccgacatggcactttggtggacaatcaagtatcacactgtactccagaagctgtccaaatacccactgattgatttcagcaaggatgagcaggtgcattgcttcaagcatgtcatcgtcggcctccatgcttacatggagttcacaatcgactcgtccaaggccccgcacaactattctatggtcgacttcaacagattcatgcgcggagcttactcgctgcccagggacaccgttacagtgcttggagagtaccccaaggtcaagccaagattgctcatcatcaagaggcaccgaacgaggatgttcctcaacctcgatgagatcattgctatggctgaggagctcggctttgaggtggtgaccgatgaggccaatgtgagctctgacatctcaaagttcgccaggctggttaacacggtcgatgtgatgatgggagtccatggggctgggctcacaaactgtgtgttcctgccacagaatgccactctgattcagatcgtgccgtggggagggctggaatgggtatcccgcaccgatttcggcaacccagcagagctcatgggcatgcactacaagcaatacagcatcagcgtagacgagagcagcctcacggagcagtacccacgggaccatgagatcttcaagaaccctattgcattccataagcacgggttcgacttcatcaggcagactttcatggacaagcagaacgtgaagctggattgcaagaggttcaggccgattctcttggaggcattagacaatctcaacccatgaagattgtgatcgattgcttgttgggcatggtaatagagattcttgtacacaatccatttttttcttcaccattcgttcccgtttaattagtaagaaaaattcttgtttgttctatccttacctgagaatgtccccattctggaaattgtaggatagaagctgtgtgtacactgtataaattgctgtaggtgcaaagatggaacgaaattcattcaaatcacatatagcctcatc

SEQ ID NO: 157 - protein, 573 aa, Panicum virgatum
  REGION 1..573: note = Ceres Clone ID no. 1888614
  REGION 1..573: note = Ceres Seed Line no. Pv00448
  REGION 196..439: note = Pfam Name: DUF563 Pfam Description: Protein of unknown function (DUF563)
  REGION 1..573: note = Bit score of 1464.3 for HMM based on sequences of Figure 9
  REGION 1..573: note = Figure 9
MKSGERPKLVRGLRQESRRFRLLVIVVGFFLVSLTFVVISKPDAILFSLNGKLPVEQAPTSILIKQKVDSPPATSRKTATDALPGGDPRVVDDEADVRPKGTKREEEESRVLSEPDPTSGMTELTANKDGGGRKSDEETLGGEGKGKQDGEERGHAAEKHKVTLPTVSNYTIHDSEDTENGKQDDGTGSDLQGSKPLCDFSNFRANVCEMRGDVRVHPNATSIMFMEPAGSQRDELWKIKPYPRKGDEFCLSHITELTVKSSKVAPECTKYHDVPAVIFSLTGYTGNLFHDFTDVMVPLFTTASEFNGEVQFLITDMALWWTIKYHTVLQKLSKYPLIDFSKDEQVHCFKHVIVGLHAYMEFTIDSSKAPHNYSMVDFNRFMRGAYSLPRDTVTVLGEYPKVKPRLLIIKRHRTRMFLNLDEIIAMAEELGFEVVTDEANVSSDISKFARLVNTVDVMMGVHGAGLTNCVFLPQNATLIQIVPWGGLEWVSRTDFGNPAELMGMHYKQYSISVDESSLTEQYPRDHEIFKNPIAFHKHGFDFIRQTFMDKQNVKLDCKRFRPILLEALDNLNP

SEQ ID NO: 158 - protein, 573 aa, Saccharum officinarum
  REGION 1..573: note = Public GI ID no. 56409850
  REGION 196..439: note = Pfam Name: DUF563 Pfam Description: Protein of unknown function (DUF563)
  REGION 1..573: note = Bit score of 1484.6 for HMM based on sequences of Figure 9
  REGION 1..573: note = Functional Homolog Of SEQ ID NO. 157
  REGION 1..573: note = Figure 9
MKSGERPKLVRGLRQESRRFRLLVIVVGFFLVSLTFVVISKPDAILFSLNGKLPVDQAPTSILIQQKVNSPPATTLRTSTDALPGGDPRVVDDEADPRPQGFKGEEEESRVLSEPDPTSGMTELTPNKDGSGRKSDGEKLGGGGDGEGKRNEEPGHAADKHKVTLPTVSNYTIHDTEDTENAKRDDTSYDQQGSKPLCDFSNFRANVCEMRGDVRVHPNATSIMFMEPGHSQRDELWKIKPYPRKGDEFCLSHITELTVKSSKVAPECTKYHDVPAVIFSLTGYTGNLFHDFTDVMVPLFTTASEFNGEVQFLITDMALWWTIKYHTVLQKLSKYPVIDFSKDDQVHCFKHVIVGLHAYMEFTIDSSKAPHNYSMVDFNRFMRGAYSLGRDTVTVLGEYPKVKPRLLIIKRHRTRMFLNLDEIIAMAEELGFEVVIDEANVSSDISKFASLVNTVDVMMGVHGAGLTNCVFLPQNATLIQIVPWGGLEWVSRTDFGNPAELMGLHYKQYSIGVDESSLTEQYPRDHEIFKNPIAFHKKGFDFIRQTFMDKQNVKLDCKRFRPILLEALDNLNP

SEQ ID NO: 159 - DNA, 1719 bp, Sorghum bicolor
  misc_feature 1..1719: note = Ceres Annot ID no. 8740887
  misc_feature 1..1719: note = Encodes the peptide sequence at SEQ ID NO. 160
  source 1..1719: mol_type = other DNA
atgaagtccggcgagcggccgaagctggtgcggggcctccggcaggagtctcggcggttccgcctgctagtcatcgtcgtcggattcttcctcgtctccctgaccttcgtcgtcatctccaagcccgacgccatcctattcagcctgaacggcaagctaccggtggaccaggcgccgacatccatcctgatccagcagaaggttaactcgcccccagccaccacggttaagacctccaccgacgcactccgtggagaccctagagtggttgatgacgaagctgatccaagaccgcaagggttcaaaggcgaggaggaagagagccgggtcctgagcgagccggacccgaccagcgggatgacggagctgacccctaacaaggacggcagcggccgtaaatccgacgaggataagttaggcggcggcggtgacggcgaggggaaaaggagggaggagcgtgggcacgaggcggacaagcataaagtcacgctcccaaccgtttccaattacactattcatgacaccgaggacacggaaactgccaaaaaagatgatacaagttatgaccagcaggggagcaagcccctgtgtgatttctcaaattttagagcaaatgtgtgcgagatgcgtggtgatgttagagttcacccaaatgctacagaaatcatgttcatggagcctggccattcgcagagagatgagctgtggaaaattaagccataccctcggaaaggagacgagttctgccttagccatatcactgagctgacagtaaaatcaagcaaagtggccccagagtgcaccaagtaccatgacatgcctgctgtgatcttttccctgacaggctatactggaaatctgttccatgacttcactgacgtgatggtccctcttttcacgacagcaagtgagtttaatggagaagttcagttccttataacggacatggcactttggtggacaatcaagtaccacactgtgcttcagaagctgtccaagtaccctgtcattgatttcagcaaggatgaccaggtgcactgcttcaagcatgtcattgtcggcctccatgcttacatggaattcacgatagactcgtcgaaggctccacacaactattcaatggttgattttaacagattcatgcgcggagcttactcactgggcagggacaccgttaccgtgcttggagagtaccctaaggtcaagccaaggttgctcatcatcaagaggcaccgtacaaggatgttccttaaccttgatgagatcgttgcaatggctgaggagctcggctttgaggtggttatcgatgaggccaatgtgagctctgatatctccaagttcgccaggctggttaacacggtggacgttatgatgggtgtccatggagctgggcttacaaactgcgtgttcttgccacagaatgccacactgattcagattgtgccgtggggagggttggaatgggtatcccgtactgatttcggcaacccggcagagctgatggggctgcactacaagcaatacagcatcggcgtggacgagagcagcctcacggagcaatatccgagggaccatgagatcttcaagaatcctattgctttccataagaacgggtttgacttcatcaggcaaaccttcatggacaagcaaaacgtgaagctggattgcaagaggttcaggcctattctattggaggcactggataacctcaacccataa

SEQ ID NO: 160 - protein, 572 aa, Sorghum bicolor
  REGION 1..572: note = Ceres Annot ID no. 8740887
  REGION 195..438: note = Pfam Name: DUF563 Pfam Description: Protein of unknown function (DUF563)
  REGION 1..572: note = Bit score of 1481.9 for HMM based on sequences of Figure 9
  REGION 1..572: note = Functional Homolog Of SEQ ID NO. 157
  REGION 1..572: note = Figure 9
MKSGERPKLVRGLRQESRRFRLLVIVVGFFLVSLTFVVISKPDAILFSLNGKLPVDQAPTSILIQQKVNSPPATTVKTSTDALRGDPRVVDDEADPRPQGFKGEEEESRVLSEPDPTSGMTELTPNKDGSGRKSDEDKLGGGGDGEGKRREERGHEADKHKVTLPTVSNYTIHDTEDTETAKKDDTSYDQQGSKPLCDFSNFRANVCEMRGDVRVHPNATEIMFMEPGHSQRDELWKIKPYPRKGDEFCLSHITELTVKSSKVAPECTKYHDMPAVIFSLTGYTGNLFHDFTDVMVPLFTTASEFNGEVQFLITDMALWWTIKYHTVLQKLSKYPVIDFSKDDQVHCFKHVIVGLHAYMEFTIDSSKAPHNYSMVDFNRFMRGAYSLGRDTVTVLGEYPKVKPRLLIIKRHRTRMFLNLDEIVAMAEELGFEVVIDEANVSSDISKFARLVNTVDVMMGVHGAGLTNCVFLPQNATLIQIVPWGGLEWVSRTDFGNPAELMGLHYKQYSIGVDESSLTEQYPRDHEIFKNPIAFHKNGFDFIRQTFMDKQNVKLDCKRFRPILLEALDNLNP

SEQ ID NO: 161 - protein, 572 aa, Zea mays
  REGION 1..572: note = Public GI ID no. 162460428
  REGION 195..438: note = Pfam Name: DUF563 Pfam Description: Protein of unknown function (DUF563)
  REGION 1..572: note = Bit score of 1453.5 for HMM based on sequences of Figure 9
  REGION 1..572: note = Functional Homolog Of SEQ ID NO. 157
  REGION 1..572: note = Figure 9
MKSGERPKQMRGVRQESRRFRLLVIVAGFFLVSLTFVVISKPDSILSSLNGKLPVDQAPTSILIQQKVNSPPATALETSTDALRGDPRVVDDEADPRPQGFKGEEEESRVLSEPDATSGMTELTPDKDGSGRKSNEEVLGGGGDGEGKSKEDRGHGPEKHKVTLPTVSNYTIHDTEDTQNAKQDDTSNDQQGSKPLCDFSNFRANVCEMRGDVRVHPNAASIMFMEPGHSQRDELWKIKPYPRKGDEFCLSHITELTVKSSKVAPECSKYHDVPAVIFSLTGYTGNLFHDFTDVMVPLFTTASEFNGEVQFLITDMALWWTIKYHTVLEKLSKYPVIDFSKDGEVHCFKHVIVGLHAYMEFTIDSSKAPHNYSMVDFNRFMRGAYSLGRDSVTLLGEYPKVKPRLLIIKRHRTRMFLNLDEIIAMAEELGFEVVIDEANVSSDISKFAALVNTVDVMMGVHGAGLTNCVFLPQNATLIQIVPWGGLEWVSRTDFGNPAELMGLHYKQYSIGVHESSLTEQYPSDHEIFKNPISFHKKGFDFIRQTFMDKQNVKLDCKRFRPILLEALDNLNA

SEQ ID NO: 162 - protein, 576 aa, Oryza sativa
  REGION 1..576: note = Public GI ID no. 115453815
  REGION 199..442: note = Pfam Name: DUF563 Pfam Description: Protein of unknown function (DUF563)
  REGION 1..576: note = Bit score of 1468.4 for HMM based on sequences of Figure 9
  REGION 1..576: note = Functional Homolog Of SEQ ID NO. 157
  REGION 1..576: note = Figure 9
  source 1..576: note = Oryza sativa subsp. japonica
MKAGERPKLVRGVRQESRRFRLLVIVVGFFLVSLTFVFVSKPDAILFSLNGKLPVEQAPTSILIQQKVNEPSGESRKTSTDALRGDPKVVDDEADAKPKGTGGGSEEEEGRVLSEPDPTSGMMEPTHNKDGNGHKSHQETLGGGGDGESKGNDEEGEHAEQKHKVTLPTVSNYTIHDAAEDTENAKQEGMNNVQQGSKPLCDFSNFRANVCEMRGDVRIHPTATSVLFMEPEGSQRDEVWKIKPYPRKGDEFCLSHITEVTVKSSKVAPECTKYHDVPAVIFSLTGYTGNLFHDFTDVLVPLFTTASEFNGEVQFLITDMALWWTIKYQTVLQKLSKYPVIDFSKDDQVHCFKHAIVGLHAYMEFTIDSTKAPHNYSMADFNRFMRGAYSLGRDSVTVLGEYPKIKPRLLIIKRHRTRMFLNLDEIISMAEELGFEVVIDEANVSSDISRFARLVNSVDVMMGVHGAGLTNCVFLPQHATLIQIVPWGGLDWISRTDFGNPAELMGLRYKQYSIGVDESSLTDQYPRDHEIFKNPISFHQRGFDFIRQTFMDKQNVKLDCKRFRPILLEALDNLNP

SEQ ID NO: 163 - protein, 580 aa, Triticum aestivum
  REGION 1..580: note = Public GI ID no. 56409844
  REGION 203..446: note = Pfam Name: DUF563 Pfam Description: Protein of unknown function (DUF563)
  REGION 1..580: note = Bit score of 1414.3 for HMM based on sequences of Figure 9
  REGION 1..580: note = Functional Homolog Of SEQ ID NO. 157
  REGION 1..580: note = Figure 9
MIKAGERPNSKLLRGGGRQESRRFRMLAIVVGFFIVSLTFVLVSKPDAILFGLNGKLPADQAPASILIQQKVNTPAQKTSTDAIIGGDPKVVDDETYVKPKEIRGGEEEDHRVLSEPDPASGMAEPAANKDGDARKSSDETLGGERKDEAEEERDEEKHAKVTLPTVSNYTIHDAEDAENAKQEGLSLSNVQHEQQQQQGSKPLCDFSNFRANVCEMRGDVRVHPKATSVLFMEPEGSQRDEVWKIKPYPRKGDEFCLSHITELTVKSSKVAAECTRYHDVPVVIFSLTGYTGNLFHDFTDVIVPLFTTAAQFDGEVQFLITDMALWWTVKYHTLLQKLSKYPLIDFSKDDQVRCFKHAIVGTHAYMEFTIDAAKSPNGVTMVDFNRFMRAAYSLPKAAAAALGESPRVKPRLLIIKRHRTRMFLNLEEIIGMAEELGFEVVIDEANVSSDINGFAKLVNSVDVMMGVHGAGLTNCVFLPQNATLIQIVPFGGLDWISRTDFGNPSEMMGLRYKQYAITVDESSLTDHYPRDHKIFKDPISFHKRGFEFIRRTFMDKQNVRLDCKRFRPVLLEALDNLNQ

SEQ ID NO: 164 - protein, 637 aa, Hordeum vulgare
  REGION 1..637: note = Public GI ID no. 31339690
  REGION 263..509: note = Pfam Name: DUF563 Pfam Description: Protein of unknown function (DUF563)
  REGION 1..637: note = Bit score of 1498.6 for HMM based on sequences of Figure 9
  REGION 1..637: note = Functional Homolog Of SEQ ID NO. 157
  REGION 1..637: note = Figure 9
MKQQGYGGVRFESQRFRLLSIVVGCFLISVTFLLSTRPDSIVFDTPPARTAIKTVKPSSSFSSPRGLGRDFLVDIAPKQGDAHGRQPQLSAGEKTETEWVKDTVIIQESSAVAAERAEQEEADKATAPTPARRGRYPRYYVHSCAGRTGNVPHDANKSWGARDVDVLTELAGATEEVVRDHAAAITARPAVDTTPTPATTTRHDQDQPLPVEEETRKAGGGKIKLQAEPAATEPQQLPTPGRLETSEPERRASRDQPPQLLPPLCDFSDRRSDVCDFTGDIRMDANASTFFLVVDAATAASHKVRPYPRKGDPTCMGRVPEITMRTTSSSSPPECTRTHGVPAVTFSIGGYTGNIFHDFSDVLVPLYNTVHRYRGDVQLVMANVAPWWLVKYDKLLRELSRHAPLDLAAVAAKGETHCFRHAVVSLRAHRELIIERDRSPDGLATPDFTRFIRRALSLPRDAPTRLADGTGRKPRLLIIARHRTRILLNLGDMMRVAEEAGFEAAVSELDVGDPISRVGAEINSADVLVGVHGAGLTNMMSLAPGATMVQVVPWGGLQWFARMDYGDPAEALGLRYVQYEIGVDESSLKDKYPRGHKIFTDPTSLHKKGFGFMRRTLMDGQNITIDLGRFRACSSRR

SEQ ID NO: 165 - protein, 535 aa, Arabidopsis thaliana
  REGION 1..535: note = Public GI ID no. 9294073
  REGION 154..405: note = Pfam Name: DUF563 Pfam Description: Protein of unknown function (DUF563)
  REGION 1..535: note = Bit score of 1169.1 for HMM based on sequences of Figure 9
  REGION 1..535: note = Functional Homolog Of SEQ ID NO. 157
  REGION 1..535: note = Figure 9
MTEKDLLFDTILARSFIRNEPKRLGYGAFIASLLFVFTLCTVFKPYLSPLPIVEMQLSVDAGLRMLRITEPQALRSSNDETSADSDKLIIPTNQDNVTSSEIITQSLTSSEDHKLNDTSMPKNYLDSFNYTTNTTISKEEVISDENKLEKTMKPICTKLARTEFCELNGDVRVHGKSATVSAAITFAFSGNSTWHIRPYARKGDTVAMKRVREWTVKLEQNADQLENANFSRCVRNHSVPAMIFSLGGYSMNNFHDFTDIVIPLYTTARRFNGEVQFLVTNKSPSWINKFKELVRKLSNYEVIYIDEEDETHCFSSVTVGLTRHREYFKELTIDPSNSEYSMSDFRSFLRDTYSLRNDAVATRQIRRRRPRILILARGRSRAFVNTGEIARAARQIGFKVVVAEANIGIAKFAQTVNSCDVMLGVHGAGLTNMVFLPENAVVIQVLPIGGFEWLAKTDFEKPSEGMNLRYLEYKIAVEESTLVKKYGRDHEIVRDPSAVAKHGWEMFKSVYLVQQNVSIDINRFKPVLVKALELL

SEQ ID NO: 166 - DNA, 1716 bp, Populus balsamifera
  misc_feature 1..1716: note = Ceres Annot ID no. 1473325
  misc_feature 1..1716: note = Encodes the peptide sequence at SEQ ID NO. 167
  source 1..1716: mol_type = other DNA
atgatttacgattctgtgcttggtcgaagctttagcaagcaagagcagaagaagttgggatactgggcattcgttgcttgcttgttcattgcattgagtttcttcaccaactttaagcccttcttgggccctctatcagttttgaatttgaggttatcaatgggagaagatgagaagcttcatctttttagtgatacagacagctctttgctgatagccaacgaaactgtaggcagcagcagttcaactgccaatgatacaagcagctcgcatgaagaagcagaaataatgagtacattaattgtcaatgatacagacagctctcatggagaatcagaaattcgggatgcagaaattataatgaatagtacctcaattgacaatgctacaagcagatctcaggaggtatttaaggaaagtcatacacagaacatgaaaaccaatgatacaagcaactccccaccgttagtcaaagaaaatgatatttacatggtcaacaatacaaacagctctcttccaaaagcaacagatgcagatgttgtaacaaagaacaacacaatcgagcctctatgcactctcatgggtagatcagatttctgcgagattaaaggggacatcaggattgatggaaaatcctacactgtttttatagtctcatctgaaactgacatcctgacagcagagaatacttcatggagtattaggccttatgcgcgaaaaggtgaccaagctgcaatgggtgcggttagggaatggacagtaaaacttgtgaccgttgcctcagatatccctcaatgcactcaaaatcatagtgttccggcaatccttttttcggctggaggatatgcaggaaaccattttcatgccttcactgacgtaattcttcctctgttcttgacatctagaccatacaatggagaaatacagtttcttattaccaacggtaggcctgcgtggatttccaagttcgaaacaataatgaaagcgctgtctagatatcagctgatcagcattgataacagccaagatatacactgctacgatagcatgaccgtcggcctcaaacgtcgaaccaacaaggagctcagtattgatcctgatccttcaagttctccatattccatgaaggacttcaggaagtttctaagaagttcctactctttaaagaaagcaatggcaactaaaatcaggaacggttcaaagaaaaggccaaggcttctaatcatttcgagaaagagatcgcgagcttttacaaatgttggtgaaatagttaccatggctaaaagattgggatacagggtcgtcgtagcggaacctgatgcagacgtatcaggatttgcacagattattaattcctgtgatgtggtgatgggagttcatggtgctggcctaaccaacattgttttccttcctgaaaatgcagtgctagtccaagtaattcccttcggaggaacagaatggctgtcaagaacttacttcgaagagcctgcaaaggggatgaacataaggtatttggactacaaaatcagattagaagagagcactttgatacagcaatacccagcagaccatgtagttttgagggatccctctgcaatttggaaacagggctggtctgcagttgagtcaatatatttacgtcagcaaaatgtaaccctaaatgtgaataggtttagacccactctggtaaaagctttagaccttttgcatcagtga

SEQ ID NO: 167 - protein, 475 aa, Populus trichocarpa
  REGION 1..475: note = Ceres Annot ID no. 1473325
  REGION 93..343: note = Pfam Name: DUF563 Pfam Description: Protein of unknown function (DUF563)
  REGION 1..475: note = Bit score of 1082.4 for HMM based on sequences of Figure 9
  REGION 1..475: note = Functional Homolog Of SEQ ID NO. 157
  REGION 1..475: note = Figure 9
MSTLIVNDTDSSHGESEIRDAEIIMNSTSIDNATSRSQEVFKESHTQNMKTNDTSNSPPLVKENDIYMVNNTNSSLPKATDADVVTKNNTIEPLCTLMGRSDFCEIKGDIRIDGKSYTVFIVSSETDILTAENTSWSIRPYARKGDQAAMGAVREWTVKLVTVASDIPQCTQNHSVPAILFSAGGYAGNHFHAFTDVILPLFLTSRPYNGEIQFLITNGRPAWISKFETIMKALSRYQLISIDNSQDIHCYDSMTVGLKRRTNKELSIDPDPSSSPYSMKDFRKFLRSSYSLKKAMATKIRNGSKKRPRLLIISRKRSRAFTNVGEIVTMAKRLGYRVVVAEPDADVSGFAQIINSCDVVMGVHGAGLTNIVFLPENAVLVQVIPFGGTEWLSRTYFEEPAKGMNIRYLDYKIRLEESTLIQQYPADHVVLRDPSAIWKQGWSAVESIYLRQQNVTLNVNRFRPTLVKALDLLHQ

SEQ ID NO: 168 - protein, 525 aa, Hordeum vulgare
  REGION 1..525: note = Public GI ID no. 31296713
  REGION 138..391: note = Pfam Name: DUF563 Pfam Description: Protein of unknown function (DUF563)
  REGION 1..525: note = Bit score of 1165.7 for HMM based on sequences of Figure 9
  REGION 1..525: note = Functional Homolog Of SEQ ID NO. 157
  REGION 1..525: note = Figure 9
MGDDHGAKLVKSLRGAAQKYVGVGFFLGFFLVLLTYFTVSEQFAIAAPNGIRRTSPGHLTLTSPAVAEKTVQQQQLPVKREEAPLPEHEQVHEKPPPVDDDEEPHRETEEPNSQTEHPIGEASKIVTTAEESAPAKKPACDIQGPWASDVCDLAGGSGGVRIHGSAHTVLVPPTIESGGSNPNPQEWRVLPYSRKHMSGIKEITVRELATPADAPRCAVTSQVPALVFAMGGLTGNYWHDFSDVMIPLYLQASRFDGEVQLVVTNYQRWYAGKYRDIIARLSRYDVVDMDKDDQVRCFPSAVVGIRMPKEFSIDPAKEPTGHSMPEFTKFLRNVFALPRAGPMGVTAGPSDGKKKPRMMIISRRHPRKLVNVDEVVALAKRIGFEVVIGDPPFNVDVADFAREVNAADVLMGVHGAGMTNSLFLPTGAVFIQVNPFGKMEHIGEVDFGTPAVDMGLKYMSYSCGMEESTLVDTLGRDHPAVKDPESIHRSGWNKVAEFYLGKQDVKLDLQRFEPVLLKAMAMLRE

SEQ ID NO: 169 - DNA, 1558 bp, Gossypium hirsutum
  misc_feature 1..1558: note = Ceres Clone ID no. 1925376
  misc_feature 1..1558: note = Encodes the peptide sequence at SEQ ID NO. 170
  source 1..1558: mol_type = other DNA
gtgagcaaaaatgcataagtgcaccctattttgtagcagctttaaagagaagaggttaacacatggtgtaatagttggatgcttgcttgcggctttcactatttcaatagttttcaagtcttatttctgcactcaactatctgtcttgcatatacaatcacaatcatccatggatgctgctgaaaatcaatttatgatgtttaaggatgccggccttttgcaggaactagttgaagagagcacatctgccaagtcaatattcaatgcatgcgattgcgaaccaatatcgaattactgcgaaatcaacggggacgttgcagttcaggggaattcctccactatatctatggtttcattacgaacagacattcctgcaggggagatttcttggacggttaagccttatgtacgaaaagaaaatgcagcagccatggatcttgttaaaagctgggccgtaacttcaatggagttccttcactgtgaccttattcaaactgttccagccatccttttctcccttggaggattttcagggaaccatttccatgatttcagtgacttggtcattccactatacataacgtctaggcagttcaatggagaagtacaatttgttgtgacagataacaggcattggtggatcagtaagttccgaggaatactcggaaacttatctcgatacgacattgtcgaaatcgatcaagaaaggaaaacacattgctacccaagtatgattgttggccttaaatatcaccatgaacttggtattgatcaatcaaagtcccaactatcaatgaaagatttcaggcaattcttgagaagaacctactcattgaagagggcaaaagcaatcaagataggagatgatgcccgtaaaaggcttcgactgttgatcataactcgaagaaaatctcgatcgttcacaaatatcgacaaaataacgagaatggcaagtagcttggggtataatgtagttacaatggagcctaatatttcaaccagcttagggagtgtagctgaaacagtgaattcttgtgatgtattgatgggaatccatggagctgggctaacgaacatggtgttccttcctgataatgccattgtaatccaaatagttcctttaggatctattgatgagctggctaaacaagactttgaacaacctgccatggatatggagttaagttacttggagtataaaataaaggcaaaggagagctcacttataagtaaatataaggcggatcatttgatcattaaagaccctttatcagttcataaacaggggtgggatgcagtaaggtcaatatatttggataaacagaatgtgaagcttgatatcaagaggtttagaccaacattgttgaaagcacttcagttgcttcatcagtagaccatatttgtattctcgatgttatttcatgtgctaatagttctctgactgaataggccaaatgattagatgttattattgggagtggggagtctagttgtacctttaagaaaactaaattagtcttttaaatttattttagttttttttttattttttttatgg

SEQ ID NO: 170 - protein, 460 aa, Gossypium hirsutum
  REGION 1..460: note = Ceres Clone ID no. 1925376
  REGION 85..326: note = Pfam Name: DUF563 Pfam Description: Protein of unknown function (DUF563)
  REGION 1..460: note = Bit score of 1018.4 for HMM based on sequences of Figure 9
  REGION 1..460: note = Functional Homolog Of SEQ ID NO. 157
  REGION 1..460: note = Figure 9
MHKCTLFCSSFKEKRLTHGVIVGCLLAAFTISIVFKSYFCTQLSVLHIQSQSSMDAAENQFMMFKDAGLLQELVEESTSAKSIFNACDCEPISNYCEINGDVAVQGNSSTISMVSLRTDIPAGEISWTVKPYVRKENAAAMDLVKSWAVTSMEFLHCDLIQTVPAILFSLGGFSGNHFHDFSDLVIPLYITSRQFNGEVQFVVTDNRHWWISKFRGILGNLSRYDIVEIDQERKTHCYPSMIVGLKYHHELGIDQSKSQLSMKDFRQFLRRTYSLKRAKAIKIGDDARKRLRLLIITRRKSRSFTNIDKITRMASSLGYNVVTMEPNISTSLGSVAETVNSCDVLMGIHGAGLTNMVFLPDNAIVIQIVPLGSIDELAKQDFEQPAMDMELSYLEYKIKAKESSLISKYKADHLIIKDPLSVHKQGWDAVRSIYLDKQNVKLDIKRFRPTLLKALQLLHQ

SEQ ID NO: 171 - protein, 572 aa, Sorghum bicolor
  REGION 1..572: note = Public GI ID no. 56409848
  REGION 195..438: note = Pfam Name: DUF563 Pfam Description: Protein of unknown function (DUF563)
  REGION 1..572: note = Bit score of 1477.5 for HMM based on sequences of Figure 9
  REGION 1..572: note = Functional Homolog Of SEQ ID NO. 157
MKSGERPKLVRGLRQESRRFRLLVIVVGFFLVSLTFVVISKPDAILFSLNGKLPVDQAPTSILIQQKVNSPPATTAKTSTDALRGDPRVVDDEADPRPQGFKGEEEESRVLSEPDPTSGMTELTPNKDGSGRKSDEDKLGGGGDGEGKRREERGHEADKHKVTLPTVSNYTIHDTEDTETAKKDDTSYDQQGSKPLCDFSNFRANVCEMRGDVRVHPNATEIMFMEPGHSQRDELWKIKPYPRKGDEFCLSHITELTVKSSKVAPECTKYHDMPAVIFSLTGYTGNLFHDFTDVMVPLFTTASEFNGEVQFLITDMALWWTIKYHTVLQKLSKYPVIDFSKDDQVHCFKHVIVGLHAYMEFTIDSSKAPHNYSMVDFNRFMRGAYSLGRDTVTVLGEYPKVKPRLLIIKRHRTRMFLNLDEIVVMAEELGFEVVIDEANVSSDISKFARLVNTVDVMMGVHGAGLTNCVFLPQNATLIQIVPWGGLEWVSRTDFGNPAELMGLHYKQYSIGVDESSLTEQYPRDHEIFKNPIAFHKNGFDFIRQTFMDKQNVKLDCKRFRPILLEALDNLNP

SEQ ID NO: 172 - protein, 576 aa, Oryza sativa
  REGION 1..576: note = Public GI ID no. 125544555
  REGION 199..442: note = Pfam Name: DUF563 Pfam Description: Protein of unknown function (DUF563)
  REGION 1..576: note = Bit score of 1462.2 for HMM based on sequences of Figure 9
  REGION 1..576: note = Functional Homolog Of SEQ ID NO. 157
  source 1..576: note = Oryza sativa subsp. indica
MKAGERPKLVRGVRQESRRFRLLVIVVGFFLVSLTFVFVSKPDAILFSLNGKLPVEQAPTSILIQQKVNEPSGESRKTSTDALRGDPKVVDDEADAKPKGTGGGSEEEEGIVLSEPDPTSGMIEPTHNKDGNGHKSHQETLGGGGDGESKGNDEEGEHAEQKHKVTLPTVSNYTIHDAAEDTENAKQEGMNNVQQGSKPLCDFSNFRANVCEMRGDVRIHPTATSVLFMEPEGSQRDEVWKIKPYPRKGDEFCLSHITEVTVKSSKVAPECTKYHDVPAVIFSLTGYTGNLFHDFTDVLVPLFTTASEFNGEVQFLITDMALWWTIKYQTVLQKLSKYPVIDFSKDDQVHCFKHAIVGLHAYMEFTIDSTKAPHNYSMADFNRFMRGAYSLGRDSVTVLGEYPKIKPRLLIIKRHRTRMFLNLDEIISMAEELGFEVVIDEANVSSDISRFARLVNSVDVMMGVHGAGLTNCVFLPQHATLIQIVPWGGLDWISRTDFGNPAELMGLRYKQYSIGVDESSLTDQYPRDHEIFKNPISFHQRGFDFIRQTFMDKQNVKLDCKRFRPILLEALDNLNP

SEQ ID NO: 173 - protein, 583 aa, Oryza sativa
  REGION 1..583: note = Public GI ID no. 115445881
  REGION 206..449: note = Pfam Name: DUF563 Pfam Description: Protein of unknown function (DUF563)
  REGION 1..583: note = Bit score of 1166.9 for HMM based on sequences of Figure 9
  REGION 1..583: note = Functional Homolog Of SEQ ID NO. 157
  source 1..583: note = Oryza sativa subsp. japonica
MKPVERAKLVRSLRQESRRLRLLVLVIGFFLVTLTFVVISKPDALLFNLNGRLSVDHAPRSLLIRQRIHADSRRSADTFPAAEDPKVVDEDEGAEDATAKGTSEEEKRLLSSEPEQGKNEEAATASEVLGGGGEEDNKNGEEEGHTQHSKVTLPTVSNYTIRDAEDTDNGKQEDGKPNEKYEFEMDADKGDNVEPETDNEEWNKKPLCDFSNFRANVCEMRGNIRIHPNASSVMYMEPASSKREEIWKVKPYPRKGDELCLGHITEITVKSSKVAPECSKYHNVPAVVFALTGYTGNLFHDFTDVLVPLFTTASEFNGEVQFLITDMAIWWTRKYKVVFDKLSKYPLIDFNNDDQVHCFKHAIVGLHAYMEFTIDSSKAPHNYSMVDFNRFMRRTYSLPRDFVTALGEIPKAKPRLLIISRQRTRMFLNLNEIVAMAEEIGYEVVVEEANVSSDLSHFGKVVNSVDVMMGVHGAGLTNCVFLPQNATLIQIVPWGGLDWISRIDFGNPAEQMGLRYKQYSIGVHESSLTDQYPLDHEIFTNPLSFHKHGFEFIRQTFMDKQNVKLDCNRFKPVLLEVLDQLNQ

SEQ ID NO: 174 - DNA, 1770 bp, Sorghum bicolor
  misc_feature 1..1770: note = Ceres Annot ID no. 8674833
  misc_feature 1..1770: note = Encodes the peptide sequence at SEQ ID NO. 175
  source 1..1770: mol_type = other DNA
atgaaggcggtggagcgcgcgaaactggtgaggagcctccggcacgagtcgcggcggctgcgtctactcgtcctcgtcatcggtttcttcctcgtcacgctcaccttcgttgtcgtctccaagcccgacgccctcctcttcaacctgaacggcaggctgttggtggaccaggcgccgcgctcgctcttgatccgccagcgggttgacgcccacgacgggagatccgccgacactctcgcctctgcctctggggatctaaaggtggtcgacgacgataccgccggcgaggaagccagcaccaacgccatagggaccagtggagaggaggaacgggtgctcgctagcgagcccgagcagagcaaaagggcagtggaagccactacatcagagattttaggtggggaacacgacgagggaaggaaaagccagcaagagggggagaaagagcaccagcagcacaagttgactctcccaactgtttcaaattataccattcatgatgccactgatggcaccgacaatggcaaccgggatgatgcagaatttaagcccactctggatgttgaccagagaaatggtcgtgacagatctcatcaagcagcattggataatgtggagcgggacaaaccattgtgtgatttctcaaacttcagagcaaatacctgtgagatgagaggtaacatcagaatacacccaaatggcagttcggtcatttacgtggaacctacaagttcaagtccaaagagaaatgaacaatggaaaattaagccttaccctcgcaaaggtgatgaattatgccttaatcatattacagaagtgacagtgaaatccagcaaagtggcacctgagtgttccaagtaccatcatgtgcctgctgtgatctttgctctgactggatacactggaaatctattccatgacttcaccgacgtgcttgtcccccttttcacgactgcaagtgagttcaatggtgaagttcaattcctaatcacagacatggctatttggtggacaaggaagtatgcagtggtgtttgagaagttaactaagtaccccttgattgatttcaacaaagacaatgaagtgcattgcttcaagcatgccatcgttggccttcatgcttacatggagttcacaattgacccgttaaaggctccacacaattactcaatggtggacttcaaccggttcatgcgcaggacctactctctgcctagggatgcagtgacagcacttggtgagatcccgaagaccaggccaaggttgctgattatctccaggcaaaggacaagaatgttcctcaatctcaaggaaatcgtggccatggctgacgagataggctatgacgtggtggttgaagaggccaatgtgaactccaatgtcactcattttgccaaggtagttaactccgtcgatgtgatgatgggtgtccatggtgctgggctcacaaattgtgtgttccttccacacgatgccatactgattcagattgtaccttggggtgctctagatgggatatgcagaattgattttggctacccagcagaacaaatgggcttgagatacaagcactacagcataggtgtgcacgagagcagcctcacggagcaataccccctggatcacgagatcttcagaaacccacttgctttccacaagaatggattcgagtttgtcagacaaaccttcatggatacacaaaatgtgaggcttgattgcaaccgtttcagacctatactcttggaggctcttgatcaattgaaccaataa

SEQ ID NO: 175 - protein, 589 aa, Sorghum bicolor
  REGION 1..589: note = Ceres Annot ID no. 8674833
  REGION 210..455: note = Pfam Name: DUF563 Pfam Description: Protein of unknown function (DUF563)
  REGION 1..589: note = Bit score of 1066.7 for HMM based on sequences of Figure 9
  REGION 1..589: note = Functional Homolog Of SEQ ID NO. 157
MKAVERAKLVRSLRHESRRLRLLVLVIGFFLVTLTFVVVSKPDALLFNLNGRLLVDQAPRSLLIRQRVDAHDGRSADTLASASGDLKVVDDDTAGEEASTNAIGTSGEEERVLASEPEQSKRAVEATTSEILGGEHDEGRKSQQEGEKEHQQHKLTLPTVSNYTIHDATDGTDNGNRDDAEFKPTLDVDQRNGRDRSHQAALDNVERDKPLCDFSNFRANTCEMRGNIRIHPNGSSVIYVEPTSSSPKRNEQWKIKPYPRKGDELCLNHITEVTVKSSKVAPECSKYHHVPAVIFALTGYTGNLFHDFTDVLVPLFTTASEFNGEVQFLITDMAIWWTRKYAVVFEKLTKYPLIDFNKDNEVHCFKHAIVGLHAYMEFTIDPLKAPHNYSMVDFNRFMRRTYSLPRDAVTALGEIPKTRPRLLIISRQRTRMFLNLKEIVAMADEIGYDVVVEEANVNSNVTHFAKVVNSVDVMMGVHGAGLTNCVFLPHDAILIQIVPWGALDGICRIDFGYPAEQMGLRYKHYSIGVHESSLTEQYPLDHEIFRNPLAFHKNGFEFVRQTFMDTQNVRLDCNRFRPILLEALDQLNQ

SEQ ID NO: 176 - DNA, 1892 bp, Triticum aestivum
  misc_feature 1..1892: note = Ceres Clone ID no. 914572
  misc_feature 1..1892: note = Encodes the peptide sequence at SEQ ID NO. 177
  source 1..1892: mol_type = other DNA
gttccccacccactcctcccttcctcttccttcttccctccctccctcgggccgtggagcccggtcagacgcacaaggacacacgcaacgagccaggactgacgaccgcgtctctccttctccgctcatcttccaccactgtctccgccccgttccttgcacgcctcttcgtcctccgtgcgtgttaggccgagagagacctggtggccacgatgatgaaggcgggggagcggcccaactcgaagctgctccgcgggggcggccggcaggagtcgcggcggttccggatgctggccatcgttgtcggattcttcatcgtctccctcaccttcgtcctcgtctccaagcccgacgccatcctcttcggcctgaacggcaagctgccggcggaccaggcgccggcgtccatactgatccagcagaaggtcaacacgccggcccagaagacctccaccgacgctatcatcggtggagaccccaaagtggtcgacgatgaaacctatgtaaagccaaaaggcttgagcttgagcaacgtccagcaggagcagcagcagcaggggagcaagccgctgtgcgacttctcgaacttccgggcgaacgtgtgcgagatgcgcggcgacgtgagggtgcacccgaaggcgacgtcggtgctgttcatggagcccgaggggtcgcagagggacgaggtgtggaagatcaagccctacccgcggaaaggcgacgagttctgcctcagccacatcacggagctgacggtgaagtcgagcaaggttgccgccgagtgcacccggtaccacgacgtgcctgtggtgatcttctcgctcaccggctacacggggaacctatttcacgacttcaccgacgtgatcgtgccgctcttcaccacggccagccagttcgacggcgaggtgcagttcctcatcacggacatggcgctctggtggaccatcaagtaccacaccctgctccagaagctgtccaagtacccccttatcgacttcagcaaggacgaccaggtgcactgcttcaagcacgccatcgtcggcacgcacgcctacatggagttcaccatcgacgccaccaagtcgccgaacggggtcaccatggtcgacttcaaccggttcatgcggtcggcctactcgctgcccaaggccgccgcggcggcgctcggggagagccccagggtgaagccgaggctgctcatcatcaagcggcaccgcaccaggatgttccttaacctggaggagattatcggcatggccgaggagctcgggttcgaggtggtgatcgacgaggccaacgtgagctccgacatcaacggcttcgccaagctggtgaactcggtggacgtgatgatgggcgtgcacggcgccgggctcaccaactgcgtcttcctgccgcagaacgccacgctcatccagatcgtgcccttcggcggcctcgactggatctcccgcaccgacttcgggaacccgtcggagatgatgggcctccggtacaagcagtacgccattaccgtcgacgagagcagcctcaccgaccactacccgagggaccacaagatcttcaaggaccccatctccttccacaagcgtgggttcgagttcatcaggcgcaccttcatggacaagcagaacgtgaggctcgactgcaagaggttcagacctgtgctgctggaggcactggacaacctcaaccagtaaatttaaggcaacttgccacccatttttaccattcgtttcgtgaaatttgatgttcattctctcatggcgtgtatgtatggtctaaactatagagattttgtctaggaattactcgtgtaaactgtataaattaaattgcccgccgctgcaaagatggaacgaaattcattgaaatgatataggcccctc

SEQ ID NO: 177 - protein, 496 aa, Triticum aestivum
  REGION 1..496: note = Ceres Clone ID no. 914572
  REGION 119..362: note = Pfam Name: DUF563 Pfam Description: Protein of unknown function (DUF563)
  REGION 1..496: note = Bit score of 1207.5 for HMM based on sequences of Figure 9
  REGION 1..496: note = Functional Homolog Of SEQ ID NO. 157
MMKAGERPNSKLLRGGGRQESRRFRMLAIVVGFFIVSLTFVLVSKPDAILFGLNGKLPADQAPASILIQQKVNTPAQKTSTDAIIGGDPKVVDDETYVKPKGLSLSNVQQEQQQQGSKPLCDFSNFRANVCEMRGDVRVHPKATSVLFMEPEGSQRDEVWKIKPYPRKGDEFCLSHITELTVKSSKVAAECTRYHDVPVVIFSLTGYTGNLFHDFTDVIVPLFTTASQFDGEVQFLITDMALWWTIKYHTLLQKLSKYPLIDFSKDDQVHCFKHAIVGTHAYMEFTIDATKSPNGVTMVDFNRFMRSAYSLPKAAAAALGESPRVKPRLLIIKRHRTRMFLNLEEIIGMAEELGFEVVIDEANVSSDINGFAKLVNSVDVMMGVHGAGLTNCVFLPQNATLIQIVPFGGLDWISRTDFGNPSEMMGLRYKQYAITVDESSLTDHYPRDHKIFKDPISFHKRGFEFIRRTFMDKQNVRLDCKRFRPVLLEALDNLNQ

SEQ ID NO: 178 - DNA, 1881 bp, Sorghum bicolor
  misc_feature 1..1881: note = Ceres Annot ID no. 8659084
  misc_feature 1..1881: note = Encodes the peptide sequence at SEQ ID NO. 179
  source 1..1881: mol_type = other DNA
atgaagggcggcggcgccggcgacaaggccgggaggggcggcgtcggcgtcggcggcggcaggataccgcagccgctgcgcctcgactcgcagcggttcaggctgctgtccatcgtcgtcggctgctccgtcatctgcctcgtcttcctcctctcctcccgccccgacgccaccgccttcgacaccatgagccccaaggcgtcgctggtggccgcgcgccgcccggtggccgtcaagaccctgcggacctcctccgccgccgccgccgccagaggcttcggtggcgatttccatgtcgacgtccggccgcagcatcatgacgagcagaccgccggcgacaagacgatcacagaatgggtcagagacacggtgatcgtggaggagagcagcgaggcagagccggaggagacggagcccggccgtgacgccagtgccactgccgcggcgtcgtccaactccgacgaccaccctgccgcaccaggtaccgagaaggcggtccacgacgccgccgcgatcaccgtgcagccggccgcgggaacgacgacgtcgactgcgccggacaacaggccagaggagaagacgggagttgcaactggtactggtggtggtggtcagagcaaggtccagcagcagccagctcggcaacggcaagacgaggagccagcacgacaatctggcggggaccaccaccaccagcagccgctgtgcgacttctccgacttccgcagcgacatctgcgacatcgccggcgatgtccggttggacgctaacgtgtcgtcgttcgtcgtcgtcgtcgacccggcgtcggcgagcggccagcaggaggaggaggagcacaaggtccggccgtaccctcggaagggcgacgagacgtgcatggggcggatcacggagatcacggtgcgcgcgacgcgcggcgcagcgggcgcgccgcggtgcacgcggacgcacgcggcgcccgcggtggtgttctccatcggcggctacacgggcaacatcttccacgacttctccgacgtgctggtgccgctctacaacacggtgcggcggtacggcggcgacgtgcagctggtgatggccaactccgcgtcgtggtggctggtcaagtacgaccggctcctccgcgagctgtcgcgccacgcgccgctggacctcgccggcgccggcgcggcgcgggaggtgcactgcttccgccacgccgtcgtgagcctgcgcgcgcacaaggagctcatcatcgagcgggaccgcagcctggacgggctcgccacgccggacttcacgcggttcctccgccgcgcgctcgggctgccccgggacgcgcccacgcgcctcgtcgtcggcggcggcgacgggacggggaggaagaagccccggctgctgatcatctcgcgccaccgcacccggctgctcctgaacctcgacgccgtggtgcgggcggcggaggaggtcgggttcgaggcgatcgtgaacgagtcggacgtggccaacgacatcgcgcaggtcggcgggctcatcaactcgtgcgacgccatggtgggcgtgcacggagcggggctcaccaacatgatgttcctgccgccgggggcggcgctggtgcagatcgtgccgtggggcgggctgcagtggatggcgagggcggactacggcgacccggcggaggcgatggggctcaagtacatccagtacgagatcggcgtcgacgagagcacgctcaaggacaagttccccagcgggcacaagatcttcaccaacccgacggagctgcacaagaaggggttcatgttcatcaggcagacgctcatggacggccaggacatcaccgttgacgtcgcccgcttcagggaggtgctgctccaggtgctcaacaacctcgcgcagtag

SEQ ID NO: 179 - protein, 626 aa, Sorghum bicolor
  REGION 1..626: note = Ceres Annot ID no. 8659084
  REGION 234..492: note = Pfam Name: DUF563 Pfam Description: Protein of unknown function (DUF563)
  REGION 1..626: note = Bit score of 848.7 for HMM based on sequences of Figure 9
  REGION 1..626: note = Functional Homolog Of SEQ ID NO. 157
MKGGGAGDKAGRGGVGVGGGRIPQPLRLDSQRFRLLSIVVGCSVICLVFLLSSRPDATAFDTMSPKASLVAARRPVAVKTLRTSSAAAAARGFGGDFHVDVRPQHHDEQTAGDKTITEWVRDTVIVEESSEAEPEETEPGRDASATAAASSNSDDHPAAPGTEKAVHDAAAITVQPAAGTTTSTAPDNRPEEKTGVATGTGGGGQSKVQQQPARQRQDEEPARQSGGDHHHQQPLCDFSDFRSDICDIAGDVRLDANVSSFVVVVDPASASGQQEEEEHKVRPYPRKGDETCMGRITEITVRATRGAAGAPRCTRTHAAPAVVFSIGGYTGNIFHDFSDVLVPLYNTVRRYGGDVQLVMANSASWWLVKYDRLLRELSRHAPLDLAGAGAAREVHCFRHAVVSLRAHKELIIERDRSLDGLATPDFTRFLRRALGLPRDAPTRLVVGGGDGTGRKKPRLLIISRHRTRLLLNLDAVVRAAEEVGFEAIVNESDVANDIAQVGGLINSCDAMVGVHGAGLTNMMFLPPGAALVQIVPWGGLQWMARADYGDPAEAMGLKYIQYEIGVDESTLKDKFPSGHKIFTNPTELHKKGFMFIRQTLMDGQDITVDVARFREVLLQVLNNLAQ

SEQ ID NO: 180 - DNA, 2345 bp, Panicum virgatum
  misc_feature 1..2345: note = Ceres Clone ID no. 1781320
  misc_feature 1..2345: note = Encodes the peptide sequence at SEQ ID NO. 181
  source 1..2345: mol_type = other DNA
cttccgtttttattctaagcttggcgctcgcctcgcgcagccagcgagcgggcctagcctacgaggagctgcacgagaagaaaagggagaggaaaccagagcgagttcttctcggctcgggcatcgccattggctggggctagtcgctcgctccgggcttttgcgtcctcacgctagctagctactggaggaagacgcgtaagcaccgagcttcttgggagagaataaaccagctgcacggcagcatgaagggcggcggcgcgggcgacaaggccgggaggggcggcggcaagctgcagcagccgctgcgcctggagtcgcagcggttcaggctgctgtccatcgtcgtcggctgcttcgtcatctgcctcgtcttcctcctctcctcccgccccgacgccaccgccttcgacaccgtgagccccagggcgtcgctggagggcgcgcgccggcggccggccgccgtcaagaccctccaaacctcctccaccgccggcgtcggtggggatgtccatgtggacatccggccgcagcagcagcagggggggagcctgcgtcagagcgtcgagcagagcgccggcgacaagacggccacagaatgggtcagagacacggtgatcgtggaggagaggagcgacgccgaggccagcgaagctgcggcggagccggaggaggccgagcgcaacgtcgacggcaatgccgctgccgcggcgtccaaccccgacgaccagccagcaccaggcgccgagacggaggaggtccgagacgccgccgcgacagccaccgcacaacccgccgcggagaccacggcgaccgcgcccgaccggccagaggggaagccgcgagctgccggcggcggtcagagcaagctccaggagcagccagctcggcagccgcaagaggagcgccacgagccagcacgtaggggcaacgggacggcgaaagcaacgcccgaccaaaccttgtcaactggatccaacggcggggaccaccagcagccgctgtgcgacttctccgacttccgcagcgacatctgcgacatggccggcgacatccgcatggacgccaacgcgtcggcgttcgtggtcgtcgacccggcggcgagcggggccgacggcggccagtggcaccgggtccggccgtacccgcgcaagggcgacgagacgtgcatgggccggatcacggaggtcacggtgcggtcggcgggcggcgccgcgccgcggtgcacgcgggagcacgccgcgccggcggtggtgttctccatcggcgggtacacgggcaacatcttccacgacttctctgacgtgctggtgccgctgtacaacacggcgcggcggtacggcggcgacgtgcagctggtgatggcggacgtgtcgtcgtggtggctggtcaagtacgacaagctcctgcgcgcgctgtcgcggcacgcgccgcaggacctcgccagggccggcgccgccggggaggtccactgcttccggcgggccgtggtgagcctgcgcgcgcacaaggagctcatcatcgagcgggcgcgcagcgcggacggactcgcgacgccggacttcacgcggttcgtccggcgcgcgctgtcgctgccccgcgacgcgccgacgcgtctcggcgacggcacgggccggaagccccggctcctggtcatctcccgccaccacacgcggctgctcctgaacctcgacgccgtggtccgcgcggcggaggaggtcgggttcgaggccgtggtgaacgagtccgacgtgggcaacgacatcgcgcaggtcggggcgctcgtcaactcgtgcgacgcgctggtgggcgtgcacggcgccgggctcaccaacatgatgttcctgccgccgggggcgaccctggtgcagatcgtgccgtggggagggctgcagtggatggcgcgggcggactacggcgacccggcggaggcgatggggctccggtacatccagtacgaggtggccgtcggcgagagcacgctcaaggacaagttccccccggggcacaagatcttcaccgacccgacgtcgctgcacaagaagggcttcatgttcatcaggcagacgctcatggacggccaggacatcgccgtcgacgtcggccgcttcagggaggtgctgctccaggtgctcaacaacctctcgcagtagacggctctgcctgcgtatgcccgatcgagtacacacagctgcatagtacaagtatatacagtacaccggtgctatgtatacgtatattcatttagttggagctttgtatcattatacggataacggatgtacactttggcataatctttttcccctgaaagattacaatgaaacctctgcggttagtggtcc

SEQ ID NO: 181 - protein, 635 aa, Panicum virgatum
  REGION 1..635: note = Ceres Clone ID no. 1781320
  REGION 252..501: note = Pfam Name: DUF563 Pfam Description: Protein of unknown function (DUF563)
  REGION 1..635: note = Bit score of 888.3 for HMM based on sequences of Figure 9
  REGION 1..635: note = Functional Homolog Of SEQ ID NO. 157
MKGGGAGDKAGRGGGKLQQPLRLESQRFRLLSIVVGCFVICLVFLLSSRPDATAFDTVSPRASLEGARRRPAAVKTLQTSSTAGVGGDVHVDIRPQQQQGGSLRQSVEQSAGDKTATEWVRDTVIVEERSDAEASEAAAEPEEAERNVDGNAAAAASNPDDQPAPGAETEEVRDAAATATAQPAAETTATAPDRPEGKPRAAGGGQSKLQEQPARQPQEERHEPARRGNGTAKATPDQTLSTGSNGGDHQQPLCDFSDFRSDICDMAGDIRMDANASAFVVVDPAASGADGGQWHRVRPYPRKGDETCMGRITEVTVRSAGGAAPRCTREHAAPAVVFSIGGYTGNIFHDFSDVLVPLYNTARRYGGDVQLVMADVSSWWLVKYDKLLRALSRHAPQDLARAGAAGEVHCFRRAVVSLRAHKELIIERARSADGLATPDFTRFVRRALSLPRDAPTRLGDGTGRKPRLLVISRHHTRLLLNLDAVVRAAEEVGFEAVVNESDVGNDIAQVGALVNSCDALVGVHGAGLTNMMFLPPGATLVQIVPWGGLQWMARADYGDPAEAMGLRYIQYEVAVGESTLKDKFPPGHKIFTDPTSLHKKGFMFIRQTLMDGQDIAVDVGRFREVLLQVLNNLSQ

SEQ ID NO: 182 - protein, 522 aa, Oryza sativa
  REGION 1..522: note = Public GI ID no. 53791307
  REGION 139..387: note = Pfam Name: DUF563 Pfam Description: Protein of unknown function (DUF563)
  REGION 1..522: note = Bit score of 845.9 for HMM based on sequences of Figure 9
  REGION 1..522: note = Functional Homolog Of SEQ ID NO. 157
  source 1..522: note = Oryza sativa subsp. japonica
MKPGGSSGRLHALRFESQRFRLLTIVVGCFLISLTFLLSSRPDATVFSTRVKDTVIIQEVAGERSEEAEEAAERVAADSGDEAAPAVEEKNQQQLPVKLQDAGEPARTPEQTFNFEFWAPTNVADNVRAMNADSVDRRPLCDFSDFRTDICDFSGDVRMAANTSEFVVVVDPAAAAVSHKVRPYPRKGDATCMGRVTEITVRATGDAAGAPRCTRAHDVPAVAFSIGGYTGNIFHDFSDVIVPLYNTVQRYRGGVQLVMVNVASWWLVKYDKLLRELSRHAPIDLAKAGAAGEVHCFPSAVVSLRAHRELIIERERSLDGLATPDFTRFLRRALSLPRDAPTRLGDGTGRRPRLLVISRGRTRLLLNLDAVVRAAEEVGFEVVVNESDVGNSIEQVGKLINSCDALLGVHGAGLTNMMFLPPGATMVQVVPWGGLQWIARMDYGEPAAAMGLNYIQYEIAVAESSLKDKYPAGDEIFTNPTGLHKRGFAFMKQTLMDGQDITIDVTRFRPVLQQALDNLATK

SEQ ID NO: 183 - DNA, 1629 bp, Sorghum bicolor
  misc_feature 1..1629: note = Ceres Annot ID no. 8659080
  misc_feature 1..1629: note = Encodes the peptide sequence at SEQ ID NO. 184
  source 1..1629: mol_type = other DNA
atgaaagccggcggcggcggcggcgacaagaagcagcagcaggtgggtatcaggttgctgtccgtcgccgtcggctgcttcctcctcttcgtcgtcttcaccctctcctcccgctacaacgccaccttcgtcgtcgacactcgccgaggcgacttccggccatcgcagggggacagaggcggcgacggcggcgagggcgaactgaagcagcttgctcagcagagcaacgaaaaggcagcagtcacagaagcagacgaatcagtgatcggagaacagggcaacaacgtcgagagagaagcggaggctgaggaagcagagctcgagagcagcgccaccgccgcagccgccgccgacgcgacatcgaactccgacgagcaagcaaagccagctgcagccttggtgaaccagcagcggcaaccactgtgcgacctttcgggctcacgatctgatgtctgtgacttcaccggcgacatccgcttggatgccaacgcctcggcattcatcgtggtcgacccaacgggcgacgcaaacgcgccgacgtacaaggtccggccgtacgcacggaagggcgacgccacgagcatgagccgtgtcaccgaggtcaccgtgcggacgacgacggccgacgcgccgcgctgcacggcgacgcacgccgagccggcggtggtgttctccatcggcgggtacgcgggcaacctcttccacgacttcaccgacgtgatcgtgccgctctacggcaccgcgcagcgctacggcggcgtcgtccgcctagtcgtcgccgacgccggagcgggaccgtcccggtggctagccaagtacgacgccgtcctgcgcgggctctcgcgccacccgccgctcgacctcgccgccacggcgccgggggaagagacgcactgcttcggccacgtcgtggtcggcctgcgcgccgcgcaccgggagctcatgatcgacgagcgggatgagcgcagcagcggcccggacgcggtcggtgtcgggatggtcgacttcgcgcggttcctccggcgcgcgctctcgctgccccgggacgcggtcaccacgcgccccagcagcgacgccgtcgccacgggcacgaagaagccgaagcctcgcctgctgatcgtcgcccgccgcggcacccggcggctactgaacgcggacgccgtcgcgcgcgtggcggaggaggtggggttcgaggccgtggtgagcgagctggaggtgagcaagagcgacgacggcatcgcggaggtggggcggcgcatcaactcgttcgacgcggtggtgggcgtgcacggcgccgggctgaccaacatggtgttcctgccgcggggggcgacggtggtgcaggtggtgccgtggggcgggctgcagtggatcgcgcggatggacttcggcgacccggcggaggccatggggctccggtacgtccagtacgagatcgccgtgcacgagagctcgctcagggacaagtacccgagcgaccacgagatcttcaccaacccgactgcgttgcacaggaaagggttcaagttcttgaggcacaccttcttgatcggacaggatgtcacgctcgacgtcgaccgcttcagagtggtgctgctccaggcgttccagaacctcacgacgacgtag

SEQ ID NO: 184 - protein, 542 aa, Sorghum bicolor
  REGION 1..542: note = Ceres Annot ID no. 8659080
  REGION 140..404: note = Pfam Name: DUF563 Pfam Description: Protein of unknown function (DUF563)
  REGION 1..542: note = Bit score of 668.1 for HMM based on sequences of Figure 9
  REGION 1..542: note = Functional Homolog Of SEQ ID NO. 157
MKAGGGGGDKKQQQVGIRLLSVAVGCFLLFVVFTLSSRYNATFVVDTRRGDFRPSQGDRGGDGGEGELKQLAQQSNEKAAVTEADESVIGEQGNNVEREAEAEEAELESSATAAAAADATSNSDEQAKPAAALVNQQRQPLCDLSGSRSDVCDFTGDIRLDANASAFIVVDPTGDANAPTYKVRPYARKGDATSMSRVTEVTVRTTTADAPRCTATHAEPAVVFSIGGYAGNLFHDFTDVIVPLYGTAQRYGGVVRLVVADAGAGPSRWLAKYDAVLRGLSRHPPLDLAATAPGEETHCFGHVVVGLRAAHRELMIDERDERSSGPDAVGVGMVDFARFLRRALSLPRDAVTTRPSSDAVATGTKKPKPRLLIVARRGTRRLLNADAVARVAEEVGFEAVVSELEVSKSDDGIAEVGRRINSFDAVVGVHGAGLTNMVFLPRGATVVQVVPWGGLQWIARMDFGDPAEAMGLRYVQYEIAVHESSLRDKYPSDHEIFTNPTALHRKGFKFLRHTFLIGQDVTLDVDRFRVVLLQAFQNLTTT

SEQ ID NO: 185 - protein, 682 aa, Zea mays
  REGION 1..682: note = Public GI ID no. 212275650
  REGION 287..538: note = Pfam Name: DUF563 Pfam Description: Protein of unknown function (DUF563)
  REGION 1..682: note = Bit score of 615.3 for HMM based on sequences of Figure 9
  REGION 1..682: note = Functional Homolog Of SEQ ID NO. 157
MGMDAGGGKLPYSYPAHQDGKLVKSFSRVEPRKFGLALVAGFLLVTCAYFSTAKFDAIHVAMTVSPVSGNAAGIGPLVGAANADTSDSKQRLDLGKQDPDDALSRSEEEEGSRADEVLEKDDGKASSSSGTDSGSNAPLEDTRRDETFVGDSGGASSAAGARSEAVPARHEHDDDAPAAALLPPVTSEGAANSTQGSGVLEDEELQVQDAVANPSKRSNDSAATRSSSSGRSPSVVHSDPAILPAPSQQIAPAAPQEADKALAVQHIPAIPEVKQSDSETPAREWKPLCDITSNRRIDWCELDGDVRVLGANASVTLVAPPGGADGRTFRAESWRIKPYPRKADPNAMRVVRVLTVRSVPGEAPACTDRHGVPALVFSDRGYTGNYFHAFTDVILPLFLTARQYAGEVRLLVTDLQAWWVGKFAPVFRSISNYELVDLDRDPRVHCFRHVQVGLTSHDDFSIDPRRAPNGYSMLDFTGFMRAAYGLPRGDVAAAAGPSSKRRPRLLLIARARTRRFVNAEEIVRGAEKLGFEVVVSEGTHEVAPFAELANSCDAIMGVHGAGLTNMVFVPTGGVVIQVVPLGGLEFVAGYFRGPSRDMGLRYLEYRITPEESTLINQYPRDHPIFTDPNGIKSKGWESLKDAYLDKQDVSLDMKRFRPTLKKAIAHIRKARAKANAGGGGNN

SEQ ID NO: 186 - DNA, 2459 bp, Panicum virgatum
  misc_feature 1..2459: note = Ceres Clone ID no. 1818693
  misc_feature 1..2459: note = Encodes the peptide sequence at SEQ ID NO. 187
  source 1..2459: mol_type = other DNA
ttttcccccaacaaaccatcaaattaatcgcaccaccagccttgctgctacaaatgcttcggccatagctatcttcctcctcggatcttctccccgcgcgttcgtgctcgcgcagtgctgctcgtctcccccttccccttccccttccccttcccgccgctccgtctcctcgctttgagactcccctctcctctgattggagagcaagcattgtgtcagtgggatcccggaggtgccgccgctgcagggcccggtatgacgtcgacggcctactcgcggcagtcgaagctgccgggcggcggcggggagcgccggctgccgccccggctcatgcggggcctcgcgtccaagatcgagcccaagaagctcggcgtcggcctcatcgccggctgctgcctcgcgctcctcacctacgtctccctcgccaagctcttcgcaatctactcccccgtgttcgccagcacggccaacacgtccgccctgatgcagaactcgccgccgacggcgtccaagccgtcagtgccggagacggaggccatcccgccgcaggaaacactagttggccgcggcggcggaggtgacgccgtggatctgccggaggcggcgggctccgaagaacccggcttgccggatgttgtcacgagaaaggatatgccggtggcggcgggctccgatgagcccggcttgccggatgcgttgagaagaaaggacgacggcgagaatgcggcggcggcctcggagccaaagccatctgccaaggaaggggaaggggagcagaagcaaaatggcggcgccgccgccgcggcgggcgatggcaagatgacgtgcgacgagaacggcgtggacgagggcttcccgtacgcgcggccgaccgtgtgcgagctgtccggcgacatccgggtgagcccgaagcagaagaccgtgtacctggtgaacccgtcgggcgccggcgggttcgacgagggcggcgagaagcggctccggccgtacgcccgcaaggacgacttcctcctccctggcgtgacggaggtgacggtgaagtcgtccccgtccgcggcggcggcgccccggtgcacgaagcagcacgcggtgccggccgtgctcttctccgtcgccgggtacacggacaacttcttccacgacatggcggacgcgatggtcccgctgttcctgacggcggcgcacctcaagggcgaggtgcagctgctgatcaccaactacaagccgtggtgggtgcagaagtacacgccgctgctgcggaagctgtccaactacgcggtgatcaacttcgacgaggacgccggcgtgcactgcttccgggcggggttcgtgggcctgtaccgcgaccgcgacctgatcctgtccccgcacccgacccgcaacccgcgcaactacacgatggtggacttcggccggttcgtgcgcggcgcgctggcgctgccgcgcgaccggcccgcggtgctcggcgaggagcccggcatgcggccccggatgctgatcatctcccgcgcggggacgcggcggctgctgaacctggaggaggtggcggcggcggcgaaagagctcgggttcaatgtgacggtggcggaggccggcgcggacgtgccggcgttcgcggcgcaggtgaacgcggcggacgtgctgctggcggtgcacggcgcggggctgacgaaccagatcttcctgccgacgaggggcgtggtggtgcagatcgtgccgtggggcaagatggactggatggcgaccaacttctacgggcggccggcgcggggcatgcagctccggtacctcgagtactacgtcggcgaggaggagacgagcctcaaggacaagtacccgcgggagcacacggtgttcagggaccccatggcgctccacaagcagggctggcaggcgctcgccgaggtcgtcatgaagcaggacgtcaccgtcgacctcatcaggttccggcccttcctgctgcaggcgctggacaagctgcaggagtaggggggaggagctcggtcagagaccaaccggaatgagctgcagccctgggcacacgtacgcgtagacgagcagagctcaaaagggtgagaaaattgatgggggcggaggctactactaccactactgctgctaggaagaaagggaatcagggcaaggatctttcttttccttgatggtagatcgaagtgaggtggcttcatcaaattggtaaattggtttgtgtcttggtttgtaacatcttggatagtgcactacatacaatacacacggaaatgttgtgtttatttttttctgtttttttttgtttttttcacttcatttcacttggcattgtagtgaagaggctttttttttgcccccttcaaatgtgatcatactgtccataagttaatcgagccaattggtgattacagctctgccggcagtagagtttctgcatgtgctacagctgtacattccatttgcctctg

SEQ ID NO: 187 - protein, 577 aa, Panicum virgatum
  REGION 1..577: note = Ceres Clone ID no. 1818693
  REGION 189..446: note = Pfam Name: DUF563 Pfam Description: Protein of unknown function (DUF563)
  REGION 1..577: note = Bit score of 563.5 for HMM based on sequences of Figure 9
  REGION 1..577: note = Functional Homolog Of SEQ ID NO. 157
MTSTAYSRQSKLPGGGGERRLPPRLMRGLASKIEPKKLGVGLIAGCCLALLTYVSLAKLFAIYSPVFASTANTSALMQNSPPTASKPSVPETEAIPPQETLVGRGGGGDAVDLPEAAGSEEPGLPDVVTRKDMPVAAGSDEPGLPDALRRKDDGENAAAASEPKPSAKEGEGEQKQNGGAAAAAGDGKMTCDENGVDEGFPYARPTVCELSGDIRVSPKQKTVYLVNPSGAGGFDEGGEKRLRPYARKDDFLLPGVTEVTVKSSPSAAAAPRCTKQHAVPAVLFSVAGYTDNFFHDMADAMVPLFLTAAHLKGEVQLLITNYKPWWVQKYTPLLRKLSNYAVINFDEDAGVHCFRAGFVGLYRDRDLILSPHPTRNPRNYTMVDFGRFVRGALALPRDRPAVLGEEPGMRPRMLIISRAGTRRLLNLEEVAAAAKELGFNVTVAEAGADVPAFAAQVNAADVLLAVHGAGLTNQIFLPTRGVVVQIVPWGKMDWMATNFYGRPARGMQLRYLEYYVGEEETSLKDKYPREHTVFRDPMALHKQGWQALAEVVMKQDVTVDLIRFRPFLLQALDKLQE

SEQ ID NO: 188 - DNA, 2371 bp, Zea mays
  misc_feature 1..2371: note = Ceres Clone ID no. 508386
  misc_feature 1..2371: note = Encodes the peptide sequence at SEQ ID NO. 189
  source 1..2371: mol_type = other DNA
agaaccaaaccagcctccctccccagcagctcacgagagagcgcaagcaagtattactgcgcaccgcctcgcccgcgggcgtcagcgtgaagctgccgcacagctaccccgcgaggcatggggatggacgccggcggcgggaagctgccgtacagctaccccgcccaccaggacggcaagctggtgaagagcttcagccgcgtggagccccgcaagttcggcctcggcctcgtcgcgggcttcctgctcgtcacctgcgcctacttctccaccgccaagttcgacgccatccacgtcgccatgacagtcagccccgtctccggcaatgcggctgggatcggcccgctagtgggcgccgccaacgccgacacctccgactccaagcagcgattagatttgggcaagcaagacccggacgacgcgctgtccaggtccgaggaggaggaggggagcagggccgacgaggtgctggagaaggacgacggcaaggcatcctcgtcgtcggggacagattccggcagcaatgcgccgctggaggacacgaggagagacgagacctttgtgggggacagcggtggtgcatcttccgcggcgggcgccaggagtgaggcggttcctgccaggcacgagcacgacgatgacgcccccgctgccgccctgcttcctcccgtgacgtcagagggagccgcgaacagcacgcaaggatcaggagttcttgaggacgaggagctgcaggtgcaggacgctgtcgccaatccttccaagaggagcaacgattcagccgccacgcgcagcagcagcagtggccgctcgccctctgtggttcactctgatcctgccatcctccctgctccctcgcagcagattgctcctgctgctcctcaagaggcagataaggctcttgctgttcagcatattccagcgatacctgaggttaagcaatcagattcggagacgccggcgcgggagtggaagccgctgtgcgacatcacctcgaaccgccgcatcgactggtgcgagctcgacggcgacgtccgcgtgctgggcgccaacgcgagcgtcacgctggtggcgccgcccggcggggcggacggccgcaccttccgcgcggagtcgtggcgcatcaagccgtacccgcgcaaggcggacccgaacgcgatgcgcgtcgtccgcgtgctgacggtgcggtcggtgcccggcgaggcgcccgcgtgcacggaccggcacggcgtcccggcgctggtgttctcggaccgcgggtacacggggaactacttccacgcgttcacggacgtgatcctgccgctgttcctgacggcgcggcagtacgccggcgaggtgcggctgctggtgacggacctccaggcgtggtgggtgggcaagttcgcgccggtgttcaggagcatctccaactacgagctggtggacctggaccgcgacccgcgcgtgcactgcttccgccacgtccaggtggggctcaccagccacgacgacttcagcatcgacccactccgcgcccccaacggctactccatgctggacttcaccgggttcatgcgcgccgcctacgggctcccgcgcggcgacgtcgccgccgctggcccgtcgtcgaagcggcggccgaggctgctggtgatcgcgcgcgcgcggacgcggcggttcgtgaacgcggaggagatcgtgcgcggcgccgtgaagctcgggttcgaggtggtggtgtcggaggggacgcacgaggtggcgcccttcgctgagctggccaacagctgcgacgccatcatgggcgtgcacggcgccgggctgaccaacatggtgttcgtgccgacgggcggggtggtcatccaggtggtgccgctgggcgggctggagttcgtggcgggctacttccggggcccgtccagggacatggggctgcgctacctcgagtaccggatcacgccggaggagagcacgctgatcaaccagtacccgcgcgaccaccccatcttcacggaccccaatgggatcaagagcaagggctgggagtccctcaaggatgcctacctcgacaagcaggacgtgtcgctggacatgaagaggttccgccccacgctcaagaaggccatcgcgcacatcaggaaggccagggccaaggccaacgccggcggcggcggcaacaactaggcatcgccgtacatgtgctcattcatcctcctcttactctacttttgtttttcctcccctccttctcgggttatggcagtacttgtatgtagcaagcaaaatcgatcaaaatgtataatatggcagggaaagaagttagagcaaatcatatattctctttttacccccgcttttcggtgagggtcaatggtggatggagagtatgatc

SEQ ID NO: 189 - protein, 681 aa, Zea mays
  REGION 1..681: note = Ceres Clone ID no. 508386
  REGION 287..537: note = Pfam Name: DUF563 Pfam Description: Protein of unknown function (DUF563)
  REGION 1..681: note = Bit score of 614.8 for HMM based on sequences of Figure 9
  REGION 1..681: note = Functional Homolog Of SEQ ID NO. 157
MGMDAGGGKLPYSYPAHQDGKLVKSFSRVEPRKFGLGLVAGFLLVTCAYFSTAKFDAIHVAMTVSPVSGNAAGIGPLVGAANADTSDSKQRLDLGKQDPDDALSRSEEEEGSRADEVLEKDDGKASSSSGTDSGSNAPLEDTRRDETFVGDSGGASSAAGARSEAVPARHEHDDDAPAAALLPPVTSEGAANSTQGSGVLEDEELQVQDAVANPSKRSNDSAATRSSSSGRSPSVVHSDPAILPAPSQQIAPAAPQEADKALAVQHIPAIPEVKQSDSETPAREWKPLCDITSNRRIDWCELDGDVRVLGANASVTLVAPPGGADGRTFRAESWRIKPYPRKADPNAMRVVRVLTVRSVPGEAPACTDRHGVPALVFSDRGYTGNYFHAFTDVILPLFLTARQYAGEVRLLVTDLQAWWVGKFAPVFRSISNYELVDLDRDPRVHCFRHVQVGLTSHDDFSIDPLRAPNGYSMLDFTGFMRAAYGLPRGDVAAAGPSSKRRPRLLVIARARTRRFVNAEEIVRGAVKLGFEVVVSEGTHEVAPFAELANSCDAIMGVHGAGLTNMVFVPTGGVVIQVVPLGGLEFVAGYFRGPSRDMGLRYLEYRITPEESTLINQYPRDHPIFTDPNGIKSKGWESLKDAYLDKQDVSLDMKRFRPTLKKAIAHIRKARAKANAGGGGNN

SEQ ID NO: 190 - protein, 700 aa, Oryza sativa
  REGION 1..700: note = Public GI ID no. 53791309
  REGION 300..559: note = Pfam Name: DUF563 Pfam Description: Protein of unknown function (DUF563)
  REGION 1..700: note = Bit score of 591.3 for HMM based on sequences of Figure 9
  REGION 1..700: note = Functional Homolog Of SEQ ID NO. 157
  source 1..700: note = Oryza sativa subsp. japonica
MEGGGKAGYSYGGHHHHQDAKLLKNLSRVEPRRFGLGLVAGFLIVTCAYFSTAKFDAIHIAMSTPAHLLLLLLTHLHAYLCISLLSPWILAVSSPAKNAAGFMNASSDGSNQQQLDLDRDAMSREGSKAQVLDTDGDDKISSLGPDLGHNASALEGKKKDETFAKDSGDASVSASTDEALAKDDDAIVGAVLPPLSSEEPTNITQDSVLEDEELKVQETAPATTNPSPEKSSNNGSSPSVVPSDPATLPVQQIPPTQEAKDPPAQQIPAVPEAKVPPVQQIPTFPVVKTEAAPRRKEWKPLCDLWSNRRIDWCELDGDVRVAGANGTVSLVAPPGPADERTFRAESWHIKPYPRKADPNAMRHVRVLTVQSLPAPAASAAAPACTERHDVPGLVFSDRGYTGNYFHAYTDVILPLFLTARQYSGEVKLLVSDFQMWWLGKFLPVFKAVSNYDLINLDDDRRVHCFRHVQVGLTCHADFSIDPSRAPNGYSMVDFTRFMRATYRLPRDAPFPASGEQQPRRPWRPRLLVIARARTRRFVNADEIVRGAERAGFEVVVSEGEHEVAPFAELANTCDAMVGVHGAGLTNMVFLPTGGVVIQVVPLGGLEFVAGYFRGPSRDMGLRYLEYRITPEESTLIDQYPRDHPIFTDPDGVKSKGWNSLKEAYLDKQDVRLDMKRFRPILKKAIAHLRKNSGNNNTTHN

SEQ ID NO: 191 - DNA, 2058 bp, Sorghum bicolor
  misc_feature 1..2058: note = Ceres Annot ID no. 8659051
  misc_feature 1..2058: note = Encodes the peptide sequence at SEQ ID NO. 192
  source 1..2058: mol_type = other DNA
atggggatggacggcggcggcggcaagctgccgtacagctacgcggcgcaccaggacggcggcaagctggtgaagagcttcagccgcgtggagccgcgcaagttcgggctcggcctcgtcgccggcttcctcctcgtcacctgcgcctacttctccaccgccaagttcgacgccatccacatcgccatgatcagccccatttccagcaatgcggctgggatcggctcgctggtgggcgccgccgccgacacctccaactccaactccaagcagcaatttgatttgggcaagcgagacccgtccatgtccgaggaggggagcaaggccgaggtgctcgagaaagacgacggcaaggcttccccttcgggttccgggccagattccggccgcaatgcgccgctggaggacacgaggagagacgagacttttgttggggacagcggtgatgcgagcggcgtccccgcgtcttccgcggcggcgaatcctgccgcggcgggtggcaacggtgaggcggttcctgccaaggacgatgacgccgcccccgctgctgccggtcttcttcctcccgtgtcgtcagaggaagccgcgaacggcacgcaagaatcaggtggtcttgaggacgaggagctgcaggtgcaggatgctgttgccaatccttccaagaggagcaacgactccgccgccgccgccgccatcaccaccccaagcagcagcaatggcagctcgctcgctgtggttcactctgaccctgccatcctccctgctcccgcgcagcagattcctcctgctacgcaagatgtcaaggctcttgctgatcagcatgttccagcgattccagaggttaagcaagcagattcggagacgacgccggcgcgggagtggaagccgctgtgcgacctcacctcgaaccgccgcatcgactggtgcgagctcgacggcgacgtgcgcgtgctgggcgccaacgccagcgtcacgctggtggcgccgccgggcgcggacgaccgcaccttccgcgcggagtcgtggcgcatcaagccgtacccacgcaaggcggacccgaacgcgatgcacgtcgtccgcgtggtgaccgtgcagtcggtgtccggcggcggggcgccggcgtgcacggacaggtacgacgtgccggcgctggtgttctcggaccgcgggtacacgggcaactacttccacgcgttcacggacgtgatcctgccgctgttcctgacggcgcggcagtacgccggcgaggtgcggctgctggtgacggacctccaggcgtggtgggtgggcaagttctcgccggtgttcaaggccatctccaactacgagctggtggacctggacaaggacccgcgcgtgcagtgcttccgccacgtccaggtcgggctcaccagccacgacgacttcagcatcgacccgcgccgcgcgcccaacggctactccatggtcgacttcaccgcgttcatgcgcgccacctacggtctcccgcgcggcgtcgcggccgccgacgcgacgaagcggccgaggctgctgctgatcgcgcgcgcgcggacgcggcggtttgtgaacacggaggagatcgtgcgcggcgccgagaggctcgggttcgaggtggtggtgtcggaaggcacgcacgaggtggcgccattcgcggagctcgccaacagctgcgacgccatcatgggcgtgcacggcgccgggctgaccaacatggtgttcgtgccgacgggcggggtggtgatccaggtggtgccgctgggcgggctggagttcgtggcgggctacttccggggaccttccagggacatggggctgcgctacctcgagtaccggatcacgccggaggagagcacgctgatcgaccagtacccgcgcgaccaccccatcttcacggaccccaacgggatcaagagcaagggatgggagtctctcaaggacgcatacctcgacaagcaggacgtgcggctggacatgaagaggttccggccgacgctcaagaaggccatcgcgcacctcaggaaggccaaggccaaggcgaccaacggcggcggcaactaa

SEQ ID NO: 192 - protein, 685 aa, Sorghum bicolor
  REGION 1..685: note = Ceres Annot ID no. 8659051
  REGION 296..543: note = Pfam Name: DUF563 Pfam Description: Protein of unknown function (DUF563)
  REGION 1..685: note = Bit score of 611.5 for HMM based on sequences of Figure 9
  REGION 1..685: note = Functional Homolog Of SEQ ID NO. 157
MGMDGGGGKLPYSYAAHQDGGKLVKSFSRVEPRKFGLGLVAGFLLVTCAYFSTAKFDAIHIAMISPISSNAAGIGSLVGAAADTSNSNSKQQFDLGKRDPSMSEEGSKAEVLEKDDGKASPSGSGPDSGRNAPLEDTRRDETFVGDSGDASGVPASSAAANPAAAGGNGEAVPAKDDDAAPAAAGLLPPVSSEEAANGTQESGGLEDEELQVQDAVANPSKRSNDSAAAAAITTPSSSNGSSLAVVHSDPAILPAPAQQIPPATQDVKALADQHVPAIPEVKQADSETTPAREWKPLCDLTSNRRIDWCELDGDVRVLGANASVTLVAPPGADDRTFRAESWRIKPYPRKADPNAMHVVRVVTVQSVSGGGAPACTDRYDVPALVFSDRGYTGNYFHAFTDVILPLFLTARQYAGEVRLLVTDLQAWWVGKFSPVFKAISNYELVDLDKDPRVQCFRHVQVGLTSHDDFSIDPRRAPNGYSMVDFTAFMRATYGLPRGVAAADATKRPRLLLIARARTRRFVNTEEIVRGAERLGFEVVVSEGTHEVAPFAELANSCDAIMGVHGAGLTNMVFVPTGGVVIQVVPLGGLEFVAGYFRGPSRDMGLRYLEYRITPEESTLIDQYPRDHPIFTDPNGIKSKGWESLKDAYLDKQDVRLDMKRFRPTLKKAIAHLRKAKAKATNGGGN

SEQ ID NO: 193 - DNA, 2523 bp, Panicum virgatum
  misc_feature 1..2523: note = Ceres Clone ID no. 1862153
  misc_feature 1..2523: note = Encodes the peptide sequence at SEQ ID NO. 194
  source 1..2523: mol_type = other DNA
acggagtggacggacgccaccccccgctgccggcctcctcctcctggctcctccctcctctcctttcctccgccttctcttctcgccccccgtttccttccttgccgtgctcacccgcccacccgcgcatccccacatcaccccccccgcacagctcacgagcgtggcgttattgcgcgccgcctcgttgcgttagcttcggacgctttggcgtggggctacctgcgtaacggtcccggtgccgtgccgctcacgagggaggcactgactctagagagctcttctgcgtgctctggagagaggagggggggtcaggggggaggtgacaggcgaggggagccatggggatggacggcggcggcggcggcggcggcgggaagctgccgtacagctacgccggcgtcggccaccaggacggcaagctcgtcaagagcttcagccgcgtggagccgcgcaagttcgggatggggctcgtcgccggcttcctcctcgtcacctgcgcctacttctctaccgccaagttcgacgccatccacatcgccatggtcagccccatttccacggacgcggctgggattggctcgctggcgaccgccgccgccgacacctccaagcagcaattagatttgggcgtgcaggaccggaacgcgctgtcgaaggaggggagcagggccgaggtgctcgagaaagacgacggcaatgcttcctcctcgggaccagattccggccgcaatgcgccgctggaggacacgaggagagacgagacctttgtggggggcagcggtgacgcgggcgccggcgttgatgcgtcctccgcggcggccacgaatcctgccggcgagggtgaggttcctgccaaggacgatgatgccacggccgccgttcttcctcccgtgtcgttagaggaagccgcgaacggcacgcaagaatcaggtgttcttgaggacgcggagctgcaatttcaggaagctgttgctgagcttccatccaagaagagcaacgactccgccgccgccgccgctgcaagcggcaatggcagcaactcccccactgtggttcactctgatcctgctatcctccctgctccagttcagcagattcctcctgctattcaagaggtcaaggctcttgctgatcagcagattccagctgttccagaggttaagcaagcagattcggagacgccggcgcgggagtggaagccgctgtgcgacctcacgtcgaaccgccgcatcgactggtgcgagctcgacggcgacgtccgcgtgctcggcgccaacgccagcgtcaccctggtggcgccgcccgccgccgacgcccgcaccttccgggaggagtcgtggcgcatcaagccgtacccgcgcaaggccgacccgaacgccatgcgcaacgtccgcgtggtgacggtgcggtcggtgtccgccggtgcgccggcgtgcacggaccggcacgacgacgtgccggcgctggtgttctcggaccgcgggtacacgggcaactacttccacgcgtacacggacgtgatcctgccgctgttcctgacggcgcggcggtacgccggcgaggtgctgctgctggtgacggacctccagatgtggtgggtgggcaagttcctgcccgtgttcaagagcatctccaactacgagccggtcgacctggaccacgacccgcgcgtgcactgcttccggcacgtccaggtcgggctcaccaaccacgacgacttcagcatcgacccgcgccgcgcgcccaacggctactccatgctcgacttcaccaagttcatgcgcaccacctacgggctcccgcgcgacgtcgcctggcccgccgccgccaacgcgacggccggccggagccgcccccggctgctgctgatcgcgcgcgcgcggacgcggcggttcgtgaacacggatgagatcgtgcgcggcgcggagaaggtcgggttcgaggtggcggtgtcggagggggagcacgaggtggcgccgttcgcggagctggccaacagctgcgacgccatcatgggcgtgcacggcgcggggctgaccaacatggtgttcgtgccgacgggcggggtggtgatccaggtggtgccgctgggcgggctggagttcgtggccggctacttccggggcccctccagggacatgggcctgcgctacctcgagtaccggatcacgccggaggagagcacgctgatcgaccagtacccgcgcgaccacgtcatcttcaccgacccggagggcgtcaagaacaagggctgggagtccctcaaggacgcctacctcgacaagcaggacgtgcggctggacatgaggaggttccggccgacgctgaagaaggccatggcgcacctcaggaaggccaaagccgacgacgccaactaagctgccgtcgcagtgcatgtgttcatcaatcctctttgttctcttttcttcgttttggattatgtcggtgtacgtagcaaacagaaatcggccgaccaaggtgtatgatatggcaggagaaaaagaaatttagagcagcttg

SEQ ID NO: 194 - protein, 679 aa, Panicum virgatum
  REGION 1..679: note = Ceres Clone ID no. 1862153
  REGION 288..541: note = Pfam Name: DUF563 Pfam Description: Protein of unknown function (DUF563)
  REGION 1..679: note = Bit score of 609.7 for HMM based on sequences of Figure 9
  REGION 1..679: note = Functional Homolog Of SEQ ID NO. 157
MGMDGGGGGGGGKLPYSYAGVGHQDGKLVKSFSRVEPRKFGMGLVAGFLLVTCAYFSTAKFDAIHIAMVSPISTDAAGIGSLATAAADTSKQQLDLGVQDRNALSKEGSRAEVLEKDDGNASSSGPDSGRNAPLEDTRRDETFVGGSGDAGAGVDASSAAATNPAGEGEVPAKDDDATAAVLPPVSLEEAANGTQESGVLEDAELQFQEAVAELPSKKSNDSAAAAAASGNGSNSPTVVHSDPAILPAPVQQIPPAIQEVKALADQQIPAVPEVKQADSETPAREWKPLCDLTSNRRIDWCELDGDVRVLGANASVTLVAPPAADARTFREESWRIKPYPRKADPNAMRNVRVVTVRSVSAGAPACTDRHDDVPALVFSDRGYTGNYFHAYTDVILPLFLTARRYAGEVLLLVTDLQMWWVGKFLPVFKSISNYEPVDLDHDPRVHCFRHVQVGLTNHDDFSIDPRRAPNGYSMLDFTKFMRTTYGLPRDVAWPAAANATAGRSRPRLLLIARARTRRFVNTDEIVRGAEKVGFEVAVSEGEHEVAPFAELANSCDAIMGVHGAGLTNMVFVPTGGVVIQVVPLGGLEFVAGYFRGPSRDMGLRYLEYRITPEESTLIDQYPRDHVIFTDPEGVKNKGWESLKDAYLDKQDVRLDMRRFRPTLKKAMAHLRKAKADDAN

SEQ ID NO: 195 - DNA, 2296 bp, Panicum virgatum
  misc_feature 1..2296: note = Ceres Clone ID no. 1902844
  misc_feature 1..2296: note = Encodes the peptide sequence at SEQ ID NO. 196
  source 1..2296: mol_type = other DNA
ctcggatcttcttccccttgcgcgtccgtgctcgcgcagtgctgctcttttttccccttcccgctgctccgtctcctcccttacccttgaagaagactcgagactctcccctcccctcctctaattggagagcaaggcagcaagcattgtattagtggatcccggaggtgccgccgctgcagggcccggtatgacatcgacggcctactcgcggcagccgaagctgccgggcggcggcggggagcggcggctgccgccccggctcatgcggggcctcgcgtccaagatcgagcccaagaagctcggcgtcggcctcgtcgccggctgctgcctcgcgctcctcacctacgtctccctcgccaagctcttcgcaatctactcccccgtgttcgcacggccaacacatccgccctgatgcagcagaactcgccgccgacggcgtccaagccgtccgttccggagacggaggcaatcccgccgcaggaaacactagctggcggcggcggcggcggaggcggaggcagcgccgtggatctgccggaggcgtcggggtccgaagagcccggcttgcccgatgctgtcacgagaaaggatatgccggtggcggcgggttccgatgagcccggcttgccggatgcgttgagaagaaaggacgacggcgagaatgcggcggcggcctcggagccaaagccatctgccaaggaaggggaagcaggggagcagaagcagaatggcgacgccgccgcggcggcggggggcgatggcaagatgacttgcgacgagaacggcgtggacgagggcttcccgtacgcgcgtccgaccgtgtgcgagctgtccggcgacatccgggtgagcccgaagcagaagaccgtgtacctggtgaacccgtcgggcggcggcgggttcgacgagggtggcgagaagcggctccggccgtacgcccgcaaggacgacttcctcctccccggcgtgacggaggtgactgtcaagtcgtccccgtccgcggcggtggcgccccggtgcacgaagcagcacgcggtgccggccgtgctcttctccgtcgccgggtacacggacaacttcttccacgacatgacggacgcgctggtcccgctgttcctgacggcggcgcacctcaagggcgaggtgcagctgctcatcaccgactacaagccgtggtgggtgcagaagtacacgccgctgctgcggaagctgtccaactacgcggcgatcaacttcgacgaggacgccggcgtgcactgcttccgggccgggttcgtgggcctgtaccgcgaccgcgacctgatcctgtccccgcacccgacgcgcaacccgcgcaactacaccatggtggacttcggccggttcgcgcgcgccgcgctggcgctgccgcgggaccggccggcggtgctcggcgaggagcccggcgcgcggccccggatgctgatcgtctcccgcgcggggacgcggcggctgctgaacctggaggcggtggcggcggcggcggcggagctcgggttcaacgtgacggcggcggaggccggcgcgaacgtgcctgcgttcgcggcgcaggtaaacgcggcggacgtgctgctggcggtgcacggcgcggggctgacgaaccagatcttcctgccggcgggggccgtggtggtgcagatcgtgccgtggggcaagatggactggatggcgaccaacttctacgggcggccggcggtgggcatggagctccggtacctggagtactacgtcggcgaggaggagacgagcctcaaggacaagtacccgcgggagcacacggtgttcagggaccccatggcgctccacaggcaggggtggcaggctctcgccgagatcgtcatgaagcaggacgtcagcgtcaacctcaccaggttccggcccgtcctgctgcaggcgctcgacaagctgcaggagtagtgggcgagctcggtcagcgaccaacccagccagccaaccggaacgagctgcagccgcccagcgcagtgaggggggcacacgtacgttcgcgtagacgagctgaagtgctaggaagaaagggaatcagggcaaggatccttcttgtccttgatggtagatccaagtgaggcggcttcatcaaattggtttgtgtcttggtttgtaacatcttggatagtgcactacatacactacacacggaaatgttatgttcattttttctgttttctgtccttcacttcacttggcattctagtagtgaagaaatggacccttttttcttcaaatgtgatcatactgtccataagttaatcgagcc

SEQ ID NO: 196 - protein, 507 aa, Panicum virgatum
  REGION 1..507: note = Ceres Clone ID no. 1902844
  REGION 119..376: note = Pfam Name: DUF563 Pfam Description: Protein of unknown function (DUF563)
  REGION 1..507: note = Bit score of 480.0 for HMM based on sequences of Figure 9
  REGION 1..507: note = Functional Homolog Of SEQ ID NO. 157
MQQNSPPTASKPSVPETEAIPPQETLAGGGGGGGGGSAVDLPEASGSEEPGLPDAVTRKDMPVAAGSDEPGLPDALRRKDDGENAAAASEPKPSAKEGEAGEQKQNGDAAAAAGGDGKMTCDENGVDEGFPYARPTVCELSGDIRVSPKQKTVYLVNPSGGGGFDEGGEKRLRPYARKDDFLLPGVTEVTVKSSPSAAVAPRCTKQHAVPAVLFSVAGYTDNFFHDMTDALVPLFLTAAHLKGEVQLLITDYKPWWVQKYTPLLRKLSNYAAINFDEDAGVHCFRAGFVGLYRDRDLILSPHPTRNPRNYTMVDFGRFARAALALPRDRPAVLGEEPGARPRMLIVSRAGTRRLLNLEAVAAAAAELGFNVTAAEAGANVPAFAAQVNAADVLLAVHGAGLTNQIFLPAGAVVVQIVPWGKMDWMATNFYGRPAVGMELRYLEYYVGEEETSLKDKYPREHTVFRDPMALHRQGWQALAEIVMKQDVSVNLTRFRPVLLQALDKLQE

SEQ ID NO: 197 - protein, 625 aa, Zea mays
  REGION 1..625: note = Public GI ID no. 212275101
  REGION 232..483: note = Pfam Name: DUF563 Pfam Description: Protein of unknown function (DUF563)
  REGION 1..625: note = Bit score of 597.1 for HMM based on sequences of Figure 9
  REGION 1..625: note = Functional Homolog Of SEQ ID NO. 157
MGMDAGGGKLPYSYAGQQDGGKLVKSVSRVEPRRFGLGLVAGFLLVTCAYFSTAKFDAIQIAMTSRPVSSNAGGVGVGSLEVGGVVAAADTYNASRQGLDLGKKGPGATSMADEGSEAEALEKDGGKASSPSGPGVPAALLPPVSSEEAANSTLESGGLEDEELQVQDAVASGSKRSKDSAAAAAATRSANVSSPSVVHSHHAILPAPAQRIPEVKQADSETTPAREREWKPLCDVTSNRRIDWCELDGDVRVVGANASVTLVAPPGADNRTFRAESWRIKPYPRKADPNAMRFVRVLTVRSVASGSGEAACTDGGDDDVPALVFSDRGYTGNYFHAFTDVILPLFLTARRYAGEVRLLVADLQPWWVGKFLPVFRSISKYELVDLDRDPRVRCFRHVQVGLTSHADFSIDPRRAPNGYSMLDFTRFMRAAYGLPRGDVVAAAPARRPRLLVVARARTRRFVNTEEIVRGAEAVGFEAVVSEGTHEVAPFAELANGCDAIMGVHGAGLTNMVFLPTGGVVIQVVPLGGLEFVAGYFRGPSVDMGLRYLEYRIEPEESTLVDQYPRDHPIFTDPNGIKSKGWESLKDAYLDKQDVRLDMERFRPTLQEAIAHLRKAKAKANGDGNN

SEQ ID NO: 198 - DNA, 1833 bp, Panicum virgatum
  misc_feature 1..1833: note = Ceres Clone ID no. 1844210
  misc_feature 1..1833: note = Encodes the peptide sequence at SEQ ID NO. 199
  source 1..1833: mol_type = other DNA
gtgttttgttccattgtgtgcgtgggcggtgatggcgtcgtcaacggcgtactcgcggccgtccaagccgccggggccgtcggccggcgaccggagagggccgcggcttgccaaggaactcggcaagatcgagcccaagaagttgggcatcgggctggtggccggctgctgcctcgcgctgctcacctacctgtcctttgccaggctcttcgctatctactcgccagttttcgatagctcggccctggtgttgaggaacgcgccgccggcaaccacgacggtgccggcaacagaggctacgccggtggagcagaagaccgaagtggaggagcagaaggatgttacggaccctgaggcggaccccaacatggccaacataccagaggtcacaagaaaggatgaacaggaggacccggcggcgacgaagccagctgcttccgccacggaggccaagatcacctgcgacgagaacggcgttgacgagggtttcccgtacgcgcgcccgccggtgtgcgagctcaccggcgacatccggatcagccccaaggagaaaaccatgtacttcgtgaacccgtccggcgccggccccttcgacgccaacggcgagaagaagatccgcccgttcgcccgtaaggacgacttcctcctcccgggcgtcgtggaggtcacgatcaagtccgtgtcctcggccgaggccgcaccagagtgcacgcggcggcacgacgtccccgtggtggtcttctccgtggccgggtacacggacaacttcttccacgacaacacggacgtgctgatcccgctgttcctcaccacggcccacctcaagggcgaggtgcagctcctcatcaccaacttcaagccgtggtgggtgcacaagttcacgcctctgctcaagaagctctccaactacgacatgatcaacttcgacaaggacgaggggttgcactgcttccgggtaggccacctcgggatgtaccgtgaccgcgacctcatcatctccccgcacccgacgcgcaacccgcacaactactccatggtcgactacaaccggttcctccgccgcgccttcgccctgccccgcgactccccggccgtgctcggagaggagaccggcgccacgcccaagatgctcatcatcgagcgcaagggcacgcggaagctgctcaacctgcgggaggtatcggcgatgtgcgaggagctcggcttcacggtgaccgtggcggaggccggcggggacgtgcgcggctttgcggaacgcgtgaacgccgccgacgttctcctggcagtgcacggtgccgggctgacgaaccagatcttcctgccgacgggcgccgtgctggtgcagatcgtgccgtgggggaagatggactggatggcgaccaacttctacgggcagccggcgcgggacatgcggctccggtacgtggagtactacgtctcggaggaggagacgacgctcaaagacaagtaccccagggaccactacgtgttcatgaacccaatgcgcatccacggggaagggtggccagcgatcgccgagatcatcatgaagcaggatgtcatggtcaacatgacaaggttcaagccgttcttgctcaaggcgctcgacgagttgcaggagtaggagaagcctgatcgattcccctttggtttgctggtttggttccatttgtgtggttggatggggacaaatggacaattcggataggccagcacagatgcggtacaggggtgctttcgttcatttttttactctctctctctctctctctcccccccccccatttatgtcagctactaaattgtttattttcatttgcgaggctgtttggc

SEQ ID NO: 199 - protein, 530 aa, Panicum virgatum
  REGION 1..530: note = Ceres Clone ID no. 1844210
  REGION 142..399: note = Pfam Name: DUF563 Pfam Description: Protein of unknown function (DUF563)
  REGION 1..530: note = Bit score of 523.7 for HMM based on sequences of Figure 9
  REGION 1..530: note = Functional Homolog Of SEQ ID NO. 157
MASSTAYSRPSKPPGPSAGDRRGPRLAKELGKIEPKKLGIGLVAGCCLALLTYLSFARLFAIYSPVFDSSALVLRNAPPATTTVPATEATPVEQKTEVEEQKDVTDPEADPNMANIPEVTRKDEQEDPAATKPAASATEAKITCDENGVDEGFPYARPPVCELTGDIRISPKEKTMYFVNPSGAGPFDANGEKKIRPFARKDDFLLPGVVEVTIKSVSSAEAAPECTRRHDVPVVVFSVAGYTDNFFHDNTDVLIPLFLTTAHLKGEVQLLITNFKPWWVHKFTPLLKKLSNYDMINFDKDEGLHCFRVGHLGMYRDRDLIISPHPTRNPHNYSMVDYNRFLRRAFALPRDSPAVLGEETGATPKMLIIERKGTRKLLNLREVSAMCEELGFTVTVAEAGGDVRGFAERVNAADVLLAVHGAGLTNQIFLPTGAVLVQIVPWGKMDWMATNFYGQPARDMRLRYVEYYVSEEETTLKDKYPRDHYVFMNPMRIHGEGWPAIAEIIMKQDVMVNMTRFKPFLLKALDELQE

SEQ ID NO: 200 - DNA, 1995 bp, Sorghum bicolor
  misc_feature 1..1995: note = Ceres Annot ID no. 8658929
  misc_feature 1..1995: note = Encodes the peptide sequence at SEQ ID NO. 201
  source 1..1995: mol_type = other DNA
atggagggcggcggtgggaagttagcatacagctacggcggcgtggagccccgcaagttcgggctcggccttgtcgccggcctcctcctcgtatcctgcgcctacttctccaccgtcaagctcgacgccgtccacctcgtcatgagcaagcaaccgtttcaaccacaagcatattcaggcctgcaagatcaaggttcatggtcgtcgtcgaaggaggggagcaaggcagaggtgctcgagaaagacgatggcgacggcagcaacggcatttcctctttcgggcaagttcctgtaagctcgctcgaggaaaaccagaaagatgagacgtttgcgaggaataatggtggtgttgttgtctctgcggcctcaccagatccagcagcggatggtggcaaggatgaggttcctgagaaggatgatgacccaagtgccgctgctgctcttcctcccttgtcaacagattcctcagacagcacgcaagaatcatcaggtgttcttgaagatcaggaattacaggtgcagaatgccgttgcagcagctgctaatccacccaaggaaagcaatagtatccgcagcaacgacaacggcagctcctctgaaattccgtctgatccagctgaaatccctgttcctgctccctctccagaaattgagcccccttcttctgctaacgagatttctgctgattcttcggagcttaaggcggcccctccatttcagatgactccatctattcctgaggtcaagcaaacagacttggaggcgccagtgcgtgagtggaagccactgtgcgacctgacgtcgaactatcgcatcgactggtgcgagctcgagggcgacgtccgcgtggtcggctccaacggcagcgtcaccctggtggcgccccctggtgccgatgccgacaaccacaccttccacgaggagtcatggagcatcaagccgtacccgcgcaaggtggacccgaacgccatgcacagcgtccgcgcgctgacggtgcggtcggtcgtcgccatggccaccgccaccgacgcggcgccgccgccggcgtgcatggactggcacgacgtgccggcgctggtgttctcggtgcgcgggtacacgggcaactacttccacgcgtacaccgacgtgatcctgccgctgttcctgacggcgcggcagtactccggcgaggttctgctgctggtgacgggcttccaggcgtggtgggtgggcaagtacctgccggtgttcaggagcctctccaagtacgcggcggtggacctggacagcgacccgcgcgtgcactgcttccgccgcgtccaggtcgggctcaccagccaccacgacttcagcatcgacccgcgccgcgcgcccaacggctactccatgctcgacttcgcccagttcatgcgcgccacctacgcgctcccgcgcgacgtcgccctctccccctccccctcgccggagcgtcgacggcggcgcccacggctcctggtgatcgcgcgcgcgcggacgcggcggttcctgaacacggaggagatcgtgcggggcgcgcggaaggtggggttcgaggtggtggtgtcggaggggacgcacgaggtggcgccattcgcggagctggtgaacacgtgcgacgcggtggtgggcgtgcacggcgccgggctgaccaacatggtgttcctgccccggggcggggtggtggtgcaggtgctgccgctggggccgctggagttcgtggccagctacttccggggccccgccggggacatggggctcacctacctcgagtaccggatctcgccggaggagagcacgctggtggaccagtacccgcgcgaccaccccgtgctcacggaccccatgagcttgagcagcaaggccaaggactgggtgtccttcatgggggtctacctcttcaagcaggacgtccgcctcgacatgaagcgcttccggcccgtactcaagaaggcactcgcgcggcttagggccaaacccaagaataacaacaactaa

SEQ ID NO: 201 - protein, 664 aa, Sorghum bicolor
  REGION 1..664: note = Ceres Annot ID no. 8658929
  REGION 262..524: note = Pfam Name: DUF563 Pfam Description: Protein of unknown function (DUF563)
  REGION 1..664: note = Bit score of 561.3 for HMM based on sequences of Figure 9
  REGION 1..664: note = Functional Homolog Of SEQ ID NO. 157
MEGGGGKLAYSYGGVEPRKFGLGLVAGLLLVSCAYFSTVKLDAVHLVMSKQPFQPQAYSGLQDQGSWSSSKEGSKAEVLEKDDGDGSNGISSFGQVPVSSLEENQKDETFARNNGGVVVSAASPDPAADGGKDEVPEKDDDPSAAAALPPLSTDSSDSTQESSGVLEDQELQVQNAVAAAANPPKESNSIRSNDNGSSSEIPSDPAEIPVPAPSPEIEPPSSANEISADSSELKAAPPFQMTPSIPEVKQTDLEAPVREWKPLCDLTSNYRIDWCELEGDVRVVGSNGSVTLVAPPGADADNHTFHEESWSIKPYPRKVDPNAMHSVRALTVRSVVAMATATDAAPPPACMDWHDVPALVFSVRGYTGNYFHAYTDVILPLFLTARQYSGEVLLLVTGFQAWWVGKYLPVFRSLSKYAAVDLDSDPRVHCFRRVQVGLTSHHDFSIDPRRAPNGYSMLDFAQFMRATYALPRDVALSPSPSPERRRRRPRLLVIARARTRRFLNTEEIVRGARKVGFEVVVSEGTHEVAPFAELVNTCDAVVGVHGAGLTNMVFLPRGGVVVQVLPLGPLEFVASYFRGPAGDMGLTYLEYRISPEESTLVDQYPRDHPVLTDPMSLSSKAKDWVSFMGVYLFKQDVRLDMKRFRPVLKKALARLRAKPKNNNN

SEQ ID NO: 202 - protein, 524 aa, Oryza sativa
  REGION 1..524: note = Public GI ID no. 125555301
  REGION 136..393: note = Pfam Name: DUF563 Pfam Description: Protein of unknown function (DUF563)
  REGION 1..524: note = Bit score of 541.8 for HMM based on sequences of Figure 9
  REGION 1..524: note = Functional Homolog Of SEQ ID NO. 157
  source 1..524: note = Oryza sativa subsp. indica
MSSTAYTRPSKPPGPAGERRPPRLAKELGRIEPKKLGIGLVAGCCLALLAYISFARLFAIYSPVFESTSLVMKNALPASTQQNPVLAQQQSKAEDEKDVGEDETDRKVPSFAETTEKNEEEETVTKPSGDEAEATISCDENGVDEGFPYARPPVCELTGDIRISPKEKTMFFVNPSSAGAFDGNGEKKIRPYARKDDFLLPGVVEVIIKSVSSPAIAPACTRTHNVPAVVFSVAGYTDNFFHDNTDVMIPLFLTTSHLAGEVQFLITNFKPWWVHKFTPLLKKLSNYGVINFDKDDEVHCFRRGHLGLYRDRDLIISPHPTRNPRNYSMVDYNRFLRRAFGLPRDSPAVLGDKTGAKPKMLMIERKGTRKLLNLRDVAALCEDLGFAVTVAEAGADVRGFAEKVNAADVLLAVHGAGLTNQIFLPTGAVLVQIVPWGKMDWMATNFYGQPARDMRLRYVEYYVSEEETTLKDKYPRDHYVFKDPMAIHAQGWPALAEIVMKQDVTVNVTRFKPFLLKALDELQE

SEQ ID NO: 203 - DNA, 2060 bp, Triticum aestivum
  misc_feature 1..2060: note = Ceres Clone ID no. 825530
  misc_feature 1..2060: note = Encodes the peptide sequence at SEQ ID NO. 204
  source 1..2060: mol_type = other DNA
ctcacttatgagttgccgcagagcattccgattctttattaccaccctcgtttaatcatcggcgctcggcaagcagagcagctgaggtccatccagatccagccgcacgagaaagtttcaaagcatctctctctccctctctctctgtctcgagaagagtcttcctccttggggggaggcaggcggcagggaagaagcaaagcccagcaagcaagcaagcttccttgcttgctccagatctggtctaggtcggaggaggagcgggagggcgcgctggggtcggcgtcggagatgaaggcggcgctgcggagccggcaggagccgcggcgggtcagcaacggcgtcatcatcgccgccatgctcctctccctctgcgtcctcagcatcgtcaaggccagatactgctccacccccttcggcaagccggacgaccagctcaaggagcagatgaactccagcatccggatggagaccgacgacgagcccacgcccgccgccaccacggtcggagtgtcagaggaggacgcggaggaggatgtggaggaggacagcgccgccccggtgcccaaggtcaccgcggagagggcggagaagacagccgttttctccggcgccggcgcggggaggaaggataaggataaggggcacaacaagaagaagaagccgacctgcttcatgacgagcaagcgctccgagcggtgcgaggcggcgggggacatccgggtggtcggcaacgcctccaccatctacatcgactcgctggaccgggagtggcggaccaagccgtacgcgcggtaccacgaccccgtcgccatgacccacgtccgggagttcctcctcaggcccttcccggccgacgcgccgccgccggcctgcaccaagaaccactccgtccccgggtttgtgttttccaaccgcggcttctccggcaacctctaccacgactacacggacgtgctggtgccgctcttcctcagcacgcgcaggttcaacggcgaggtgcagttcctgctcagcgacctcaagccctggtgggtggccaagttccggccgctgttccggcagctgtccaagtacgaggtcgtcgacgtgaacaacgacctggaggtgcactgcctgccccgcatcgtcgtcggctccgacttccacaaggacatgggcatcgtcccgtccaaggccggcggcggcgtctccatcgtcgacttcaagcgcaccctccgcgacgccttcgggctggagcgcgccgcggcgtcccgcggcggcgccacgggcgccggcaagccgcgcctcctcatcatctcccgcaagaactcgcggcggttcctcaacgagcgggagatggcggccgccgccacggccatgggcttcgacgtgcgcatcgcggagcccgaccagcacaccgacatgtccaccttcgcgcggctggtgaactcggcggacgtgatggtgggcgtgcacggcgccgggctgaccaacatggtgttcctccccgcgggggccgtgctgatccaggtggtgccgttcgggggcctggagtggctcaccggcgtgaccttcaagaacccggcggcggacatggaggtgacgtacatggactacaacgtgcagctggaggagagctcgctgctggagcagtacccgcggaaccaccaggtgctgacggacccctacgccgtgcacaagcaggggtgggacgcgctcaaggccgcctacctggacaagcagaacgtgcggctggacctggacaagttcagggccacgctccgggacgcgctcagccggctgccgccggcgtcgacgccggcggcctgagcctcagcccgcccttctcggccgcgcccgtccccggtccggtagatgtagatccgtccgtgtatatctatctgctctgctccatgcctgcctcgttttgcttaacttgattcttgatttcttcttcttttcttcttcttcttcctcttgctcttcttctggtaagaccccattgacggcgagcaagaacttgtggtaacagaggatgtttggttcatatccttttgtgattatttgcttcttctacc

SEQ ID NO: 204 - protein, 506 aa, Triticum aestivum
  REGION 1..506: note = Ceres Clone ID no. 825530
  REGION 125..366: note = Pfam Name: DUF563 Pfam Description: Protein of unknown function (DUF563)
  REGION 1..506: note = Bit score of 536.0 for HMM based on sequences of Figure 9
  REGION 1..506: note = Functional Homolog Of SEQ ID NO. 157
MKAALRSRQEPRRVSNGVIIAAMLLSLCVLSIVKARYCSTPFGKPDDQLKEQMNSSIRMETDDEPTPAATTVGVSEEDAEEDVEEDSAAPVPKVTAERAEKTAVFSGAGAGRKDKDKGHNKKKKPTCFMTSKRSERCEAAGDIRVVGNASTIYIDSLDREWRTKPYARYHDPVAMTHVREFLLRPFPADAPPPACTKNHSVPGFVFSNRGFSGNLYHDYTDVLVPLFLSTRRFNGEVQFLLSDLKPWWVAKFRPLFRQLSKYEVVDVNNDLEVHCLPRIVVGSDFHKDMGIVPSKAGGGVSIVDFKRTLRDAFGLERAAASRGGATGAGKPRLLIISRKNSRRFLNEREMAAAATAMGFDVRIAEPDQHTDMSTFARLVNSADVMVGVHGAGLTNMVFLPAGAVLIQVVPFGGLEWLTGVTFKNPAADMEVTYMDYNVQLEESSLLEQYPRNHQVLTDPYAVHKQGWDALKAAYLDKQNVRLDLDKFRATLRDALSRLPPASTPAA

SEQ ID NO: 205 - protein, 485 aa, Oryza sativa
  REGION 1..485: note = Public GI ID no. 115444075
  REGION 111..350: note = Pfam Name: DUF563 Pfam Description: Protein of unknown function (DUF563)
  REGION 1..485: note = Bit score of 549.7 for HMM based on sequences of Figure 9
  REGION 1..485: note = Functional Homolog Of SEQ ID NO. 157
  source 1..485: note = Oryza sativa subsp. japonica
MKQSMRSRQEPRRVSNGVIIAAMLLSLCVLSIVKARYCSTPFVKPDDQLQEQMNSSIRMETDEPATMAAGEQEEDEEEESSGGGGAEPEVSATPAVVVTAAAGGGGGKRKPTCRMTSKRSERCEARGDIRVEGNASTIYIGGIDKEWKTKPYARYHDPVAMAVVREFTLKPVTESSPACTRNHSVPAFVFSNGGFSGNLYHDYTDVLVPLFLSTHQFKGQVQFLLSGLKPWWVNKFNLFFRQLTKYDILDIDNDKDVHCFPRIVVGATFHKDMGVDPKRSPGHVSVVDFKRALRRAFGLERVAASRGGATGNGKPRLLIISRKNSRRFLNEREMAQAAAAVGFEVRIAEPDQHTDMSTFAQLVNSADVMIGVHGAGLTNMVFLPRGAVLIQVVPFGGLEWLTTVTFKNPAKDMEVTYMDYNVQLEESSLIDQYPRNHQVLTDPYAVHKQGWDALKTAYLDKQNIKMDMDRFKKTLQEALDRLPPA

SEQ ID NO: 206 - DNA, 2109 bp, Panicum virgatum
  misc_feature 1..2109: note = Ceres Clone ID no. 1748522
  misc_feature 1..2109: note = Encodes the peptide sequence at SEQ ID NO. 207
  source 1..2109: mol_type = other DNA
gaggcccaaccaacacaccacaacgcctcgcttcttctcgcctcccatgtaagcaacgaatcggccaggaggaaaggaaaagctcggcaaagagcttcgaacagcgtcgtccaccgtgtgtggttccatcggaggaataattcgggggcataccataccactgagcagtgagaggcgggtagggaggagcggcggcgcaggcgatgggcggcgaggcgaagcccgccgtgagggggctcaggagctgggcgcagcggcacctcaacgccggcttcgccgccggcttcctcctcgtcctcctcacgtacctcgtcgtttcgcagcagttcgccgtcaccgcgcccaacgctgtcgcgaccaaggggtcgcggattgctgataagcaggtgatcggaggtgcaggcgatgcagaggtcgacaagaaaagggagcaggaatggcagcccaaaacggcggcggaggagcccgacaagaaggatacgtcgggggccgtccaaaccgaggagtctccgaaaagagacggcacaaacgccaaatcgttcgcagagacggacagggtggtgtgcaacacggacggccccgtctccgagacctgcgacctcgacggtgacgtccgcgtcaacggcagcgccctgtccgtgaccttcgtcccgtcgagcccgtcggagcgccgggagtggagggtccggccgtactcgcgccggaccatgacgggcgtcgagagggtcaccgtgacgcggctggggttgtccccgcaggcccccgcggcggcggcggcgccgccgccgtgcgcggtgacccacgacgcaccggccgtgctgttcgcgctcggcgggctcacgggcaactactggcacgacttcagcgacgtgctggtgccgctgttcgcggcgtcgcggcggtacggcggggaggtactgttcctggtcagcaacatccagccctggtggctgggcaagtacgaggccgtcgtgcgccggctgtccaggtacgacgccatcgacctggaccgggacgcccaggtccggtgcttcaggcacctcaccgtggggctgcgcctccacaaggagctcagcatcgtgccggagctggcgccgggggggcaccgcctgaccatggccgacttcaccgcgttcctgcgcgagacgtacgcgctcccgcgcgccgcgccggcgagcctggcgcgggagcccggcaggaagccgcggctgctgctgatccaccgcgcgcactaccgccggttcgagaacgtgccggagatcaggaaggcggcggaggcggcggggttcgaggtgaccgtggcgagcccgcgcgccgacgcgcccctgggggagacggcgcgggcggtgaacgcgcacgacgtgctgctgggcgtgcacggcgccgggctgacgaacgcggtgttcctgccgcccggcgcggtggtcatccaggtggtgccgtacggcaagctggagcgcatggcgcggacggacttcggcgagcccgtcgccgacatggggctgcgctacctggagtacagcgtggcggcggaggagagcacgctgctggagatgctggggccggagcacccggtgatcaaggaccccgaggccgtccaccgcagcggctgggacaaggtcgccgagtactacctcggcaagcaggacgtgcgcatcgacgtgaaccggttcgcgccgacgctcgcgcgggcgatcgaccacctccggcagcggtgaaggccgccgcccggggggacggtacgttcgtctccggcgacggcgtgtcccgtcgccgttgggcaaagaaaagcacagggatcgcggccacaaggaacacatatacactgtatgcacttccagttgcagatagggtagcttcgaatttaaagcgatttggtacagaattcgagcgacgcattctttcagtttgttttgtctagagcatgtagatttattgttggcgtatccatctggtagagcagccgtcaaattaagttatttgatttggtctttgttggtagactgtactggtgtcgtgtacgcggcctctcattctgacatcctgatcttttttcgtgagaagaagatgacccgtgcaccaactcatgttgcacattgaatttttttt

SEQ ID NO: 207 - protein, 504 aa, Panicum virgatum
  REGION 1..504: note = Ceres Clone ID no. 1748522
  REGION 119..369: note = Pfam Name: DUF563 Pfam Description: Protein of unknown function (DUF563)
  REGION 1..504: note = Bit score of 614.9 for HMM based on sequences of Figure 9
  REGION 1..504: note = Functional Homolog Of SEQ ID NO. 157
MGGEAKPAVRGLRSWAQRHLNAGFAAGFLLVLLTYLVVSQQFAVTAPNAVATKGSRIADKQVIGGAGDAEVDKKREQEWQPKTAAEEPDKKDTSGAVQTEESPKRDGTNAKSFAETDRVVCNTDGPVSETCDLDGDVRVNGSALSVTFVPSSPSERREWRVRPYSRRTMTGVERVTVTRLGLSPQAPAAAAAPPPCAVTHDAPAVLFALGGLTGNYWHDFSDVLVPLFAASRRYGGEVLFLVSNIQPWWLGKYEAVVRRLSRYDAIDLDRDAQVRCFRHLTVGLRLHKELSIVPELAPGGHRLTMADFTAFLRETYALPRAAPASLAREPGRKPRLLLIHRAHYRRFENVPEIRKAAEAAGFEVTVASPRADAPLGETARAVNAHDVLLGVHGAGLTNAVFLPPGAVVIQVVPYGKLERMARTDFGEPVADMGLRYLEYSVAAEESTLLEMLGPEHPVIKDPEAVHRSGWDKVAEYYLGKQDVRIDVNRFAPTLARAIDHLRQR

SEQ ID NO: 208 - protein, 504 aa, Oryza sativa
  REGION 1..504: note = Public GI ID no. 115445889
  REGION 120..366: note = Pfam Name: DUF563 Pfam Description: Protein of unknown function (DUF563)
  REGION 1..504: note = Bit score of 579.3 for HMM based on sequences of Figure 9
  REGION 1..504: note = Functional Homolog Of SEQ ID NO. 157
  source 1..504: note = Oryza sativa subsp. japonica
MKSNRNLTRGDGRRLGNAALIAFMLGSLLVLSLVRARFSPIGKPGEAIKTEEQEAMRKGSVKMETLEAADEAAASAAAAEEEEETQPKAGDTTAGGGGGGASSAAVAAASTTATDHLTKPVCYESSRRSDTCEATGDVRVHGRSQTIHISPLEQEWKVKPYCRKHDAFALSHVKEWALRPLSTADTYPAVPHCTVNSSATAFVLSTGGFTGNPFHDYTDVLIPAFITAHRFAGEVQFLVSSFKSWWTNRYMQIFQRLSKYELVDIDNDDEVRCYRSVVVGPTFHKELGVDASRTPSGYSMVDFRTMLRGALGLERAVAEPSGDRWDIRRRPRLLIISRRNSRAFLNERAMADMAMSLGFYVRLGEPDISTDVSKFARLVNSADVMVGVHGAGLTNMVFLPAGAVLIQVVPYGGLEWLARGTFKEPAADMQIHYLEYMIQLDETTLSEQYPKDDPVLKDPYSIHKQGWNALKMVYLDKQNVRPHLGRLKNTFMEALKLLPHGHTN

SEQ ID NO: 209 - DNA, 1500 bp, Sorghum bicolor
  misc_feature 1..1500: note = Ceres Annot ID no. 8671335
  misc_feature 1..1500: note = Encodes the peptide sequence at SEQ ID NO. 210
  source 1..1500: mol_type = other DNA
atgaagtcgtcgctgaggacccggcaggagccgcggcgggtcagcaacggcgtcatcatcggcgccatgctgctgtccctctgcgtcctcagcatcgtcaaggccagatactgcgccacccccttcggcaaggccgaggaccagctccaggagcagatgaactccagcatcaggatggagccggaggagtcgtcgccggccaggacgcccggagaggaggaggacgagcaggaagaggaagaagaagaaaacggggcatcggcgacccccgccaccaccacggcgcctgcggtgacgaagacgacgccgacggccgtcccggccaccgccggcaacaggggcaaggtgagcaagggcggcaagggcaagccgacgtgctacatgacgagcaagcggtcggagcggtgcgacgcgtcaggtgacatccgggtggacgggaaccgctccgccatctacgtcagcgggatagacaaggagtggaagaccaagccgtacgcgcgctaccacgaccccgtggccatggcccacgtccgcgagtacaccctcaagccgctcccggcggcggaggcgccggcgtgcaccaggaaccactccgtccctggcttcctcttctccaacggcggcttctccggcaacctgtaccacgactacaccgacgtgctggtgccgctgttcatcagcacccaccagttccgtggccgcgtgcagttcctgctcagcgggatgaagccgtggtgggtggccaagttcaccccgttcttccggcagctcaccaagtacgacgtcatcgacgtggacaacgaccaggaggtgcactgcttcccccggatcgtggccggcgccaccttccacaaggacatgggcgtcgacccacgccggtcgccgggccacgtctccgtggtggacttcaagcgcgcgctgcgccgcgcgttcggcctggagcgcgaggcggcgtcccgcggcggcgccacgggccacggcaagccacgcctcctcatcatctcccgccgtggctcccgccggttcctgaacgagcgtgagatggcgcgggccgccgccgacgccgggttcgaggtgcgtgtggcggagcccgaccagcacacggacatggccacgttcgcggcgctggtgaactcggcggacgtgatggtgggcgtgcacggcgccgggctcaccaacatggtgttcctgccccgcggcgccgtgctcatccaggtggtgccgttcggcgggctggagtggctcaccagcgtcaccttcaaggaccccgccgcggacatggaggtgaactacatggactacaacgtgaagctggaggagagctcgctgctggaccagtacccgaggaaccaccaggtgctcaccgacccctacgccgtgcacaagcagggctgggacgcgctcaagacggcgtacctggacaagcagaacatccggatggatcttgacaggttcagagccacgctgcgggaggcaatgagccggttgccgtctccgtga

SEQ ID NO: 210 - protein, 499 aa, Sorghum bicolor
  REGION 1..499: note = Ceres Annot ID no. 8671335
  REGION 124..364: note = Pfam Name: DUF563 Pfam Description: Protein of unknown function (DUF563)
  REGION 1..499: note = Bit score of 569.1 for HMM based on sequences of Figure 9
  REGION 1..499: note = Functional Homolog Of SEQ ID NO. 157
MKSSLRTRQEPRRVSNGVIIGAMLLSLCVLSIVKARYCATPFGKAEDQLQEQMNSSIRMEPEESSPARTPGEEEDEQEEEEEENGASATPATTTAPAVTKTTPTAVPATAGNRGKVSKGGKGKPTCYMTSKRSERCDASGDIRVDGNRSAIYVSGIDKEWKTKPYARYHDPVAMAHVREYTLKPLPAAEAPACTRNHSVPGFLFSNGGFSGNLYHDYTDVLVPLFISTHQFRGRVQFLLSGMKPWWVAKFTPFFRQLTKYDVIDVDNDQEVHCFPRIVAGATFHKDMGVDPRRSPGHVSVVDFKRALRRAFGLEREAASRGGATGHGKPRLLIISRRGSRRFLNEREMARAAADAGFEVRVAEPDQHTDMATFAALVNSADVMVGVHGAGLTNMVFLPRGAVLIQVVPFGGLEWLTSVTFKDPAADMEVNYMDYNVKLEESSLLDQYPRNHQVLTDPYAVHKQGWDALKTAYLDKQNIRMDLDRFRATLREAMSRLPSP

SEQ ID NO: 211 - protein, 603 aa, Oryza sativa
  REGION 1..603: note = Public GI ID no. 53791308
  REGION 213..467: note = Pfam Name: DUF563 Pfam Description: Protein of unknown function (DUF563)
  REGION 1..603: note = Bit score of 524.9 for HMM based on sequences of Figure 9
  REGION 1..603: note = Functional Homolog Of SEQ ID NO. 157
  source 1..603: note = Oryza sativa subsp. japonica
MKAAARERKPRHSNGRAAAAAAKNLSKVEPGRHLAVVRLFPACLLALLICLCVVKFFSSLSSQSQRIGTRSRMVSSWEGSASTNVPRIPVAPLIMGRVDEDISTRSPELGVVIVFVLAVSRVVTFLVETCKGLGFCHWKPLSYPMLILKGKQGSVFKNENFKNGTDSENKSRSERQVAISTENDPPPGKEESLTKSPQTAVSESEVPKPKSKISCDDKSKDEGFPYARPIVCHLSGDVRVSPATSSVTLTMPLQQGEAAARRIRPYARRDDFLLPLVREVAITSAASEGDAPSCNVSHGVPAVIFSIGGYTGNFFHDMADVLVPLYLTTFHFKGKVQLFVANYKQWWIQKYKPVLRRLSHRAVVDFDSDGDVHCFDHVIVGLVRDRDLILGQHPTRNPKGYTMVDFTRFLRHAYGLRRDKPMVLGETSGKKPRMLIISRRRTRKLLNLRQVAAMARELGFEVVVSEAGVGGGSGGVKRFASAVNSCDVLVGVHGAGLTNQAFLPRGGVVVQIVPWGRMEWMATNFYGAPAAAMELRYVEYHVAAEESSLARRYPREHAVFRDPMAIHGQGWKALADIVMTQDVKLNLRRFRPTLLRVLDLLQD

SEQ ID NO: 212 - DNA, 2066 bp, Panicum virgatum
  misc_feature 1..2066: note = Ceres Clone ID no. 1899806
  misc_feature 1..2066: note = Encodes the peptide sequence at SEQ ID NO. 213
  source 1..2066: mol_type = other DNA
acagcctcactcctcttttactccgctggacacctcccccctccccaaaacccgcgactcatgaagtcaatgattagctgagcgccatggcgtccctggtgcagcacggcaagagcagagccgccgccgccgccgccgcagcagaagcaacagcgagggagaggagggcgaggcacggcgcgagggccgcggccaggagccccggcaagccggagctcaggcgcaggcagctagccggcaggctgctgctcgcggcgtgcctcctcgccccggcgctctgcatctgcgcggccaggctcctctcgccgctgccgtcacgggtctcgtccggcgatggagtttatctggccgagggaaaccgtattagctctgatgatgctggaggggctggagctctgagctccttgcggcggggcactgtggacggccatggacctccagggcctattgcttcgattcctgcaagatttggtgttgatcatgtcagaagttcgccggaattagataaagaagttaaaagcagcaatcccgagaatcgaacgggtttggataataaatcaggtattgagggggagactatatcctcagcaaagtctggtttccctcctgaaaactctctcacgaattttcgacaatcagtcgcatatattgaagtcccaaagcctatgagtaagctacattgtgatgacaagagtaaagatgagggcttcccttatgcaaggccaatcatctgccaaatgtctggtgatgtgcgagtttctccaggaagctcatcaattgctcttactatgccaatgcaacaaggcgttgaaggcctacgggttatgccatatgctcgccgtgacgattcattgctacctcttgtaacaggagtggacatcagagcagctgcaagtgaaaatgatgctcccaaatgcagcattagccatgatgtgcctgcaattatcttctccattggtggctataccggaaacttcttccatgacatgtcagatgttctgatcccactatatctaacttcctttcggttcaaagggcgggtaaaattcttcattaccaactacaagccgtggtggattcagaagtacaaaccgatgctacggaggctatcacattatgacataattgattttgactcaaacaaggatgtccactgctttgaggaagtaattcttggtcttgtgagagatagggatctcatccttcggccacatccaacgagaaacccaaaggggtactcaatgcttgacttcacaagattcttgcgccactcttatggcctcaaaagagccagatcattagtccttggtgaaatgccaggcaagaagccaagaattctgatcatatcaaggcgaggcacaaggaagctcctgaaccttcgtcaagtggcagccatatcaagggcgctaggctttgacgtgaccatctctgaagctaggggaaacttgaagaggtttgcaacaatggtgaactcgtgtgacgtactcctagctgtccatggcgccggcctcaccaaccagatctttctcccagctcaggctgtggtgattcagatagttccatgggggaagatggattggatggccaccaacttctatggggagccagctcgcggcatgaacctgaggtacttggagtaccacatctctgaacaagagagtagccttgctcagaggtacccaagagaccacatggtgtttaaagaccccatggcgatccatggtcaaggatggaatgcattggcagacattttcatgacacaggatgtgaagctcaatctcaggagattcaggcctacactcttacaggccctggatcttcttcagttgtagtgtgacagaaaggtgacagttctgtattctttcttgtaccatctatagtcattctttgtctgttgattctttttttcctaacacaaagttcatatagttgtaaccttatgttgtgccaatgaaggatggtacgacacggcaagtcagtaaaacataatcaggttggcacaataggaattgtgggagtaaaacatatttgtaaccttattatgttattgattacttactgaactc

SEQ ID NO: 213 - protein, 581 aa, Panicum virgatum
  REGION 1..581: note = Ceres Clone ID no. 1899806
  REGION 197..450: note = Pfam Name: DUF563 Pfam Description: Protein of unknown function (DUF563)
  REGION 1..581: note = Bit score of 463.8 for HMM based on sequences of Figure 9
  REGION 1..581: note = Functional Homolog Of SEQ ID NO. 157
MASLVQHGKSRAAAAAAAAEATARERRARHGARAAARSPGKPELRRRQLAGRLLLAACLLAPALCICAARLLSPLPSRVSSGDGVYLAEGNRISSDDAGGAGALSSLRRGTVDGHGPPGPIASIPARFGVDHVRSSPELDKEVKSSNPENRTGLDNKSGIEGETISSAKSGFPPENSLTNFRQSVAYIEVPKPMSKLHCDDKSKDEGFPYARPIICQMSGDVRVSPGSSSIALTMPMQQGVEGLRVMPYARRDDSLLPLVTGVDIRAAASENDAPKCSISHDVPAIIFSIGGYTGNFFHDMSDVLIPLYLTSFRFKGRVKFFITNYKPWWIQKYKPMLRRLSHYDIIDFDSNKDVHCFEEVILGLVRDRDLILRPHPTRNPKGYSMLDFTRFLRHSYGLKRARSLVLGEMPGKKPRILIISRRGTRKLLNLRQVAAISRALGFDVTISEARGNLKRFATMVNSCDVLLAVHGAGLTNQIFLPAQAVVIQIVPWGKMDWMATNFYGEPARGMNLRYLEYHISEQESSLAQRYPRDHMVFKDPMAIHGQGWNALADIFMTQDVKLNLRRFRPTLLQALDLLQL

SEQ ID NO: 214 - DNA, 2078 bp, Panicum virgatum
  misc_feature 1..2078: note = Ceres Clone ID no. 1726616
  misc_feature 1..2078: note = Encodes the peptide sequence at SEQ ID NO. 215
  source 1..2078: mol_type = other DNA
agtcagatccaagctccacacggcagcatcagccagcagcttaagaccagtctccctcctcctccacgccttcagctaagcaaagcatctcgagccttccttccttgtcctcgtccccgttcccattccctgccggtgccagctcgcccgcccaccctttcttcttcggcttcggagagagagcagcagatcggagggggcagcgaaaggcggccgcttcgggcgcggcgcgccagatctgggccgggtgggggctccggccggcaggcggcggctgcggcgggaggaggaggacggcgagatgaagccgtcgctgcggagccggcaggagccgcggcgggtcagcaacggcgtcatcatcggcgccatgctgctctcgctctgcgtcctcagcatcgtcaaggccagatactgcgccacccccttcggcaaggcggaggaccagctccaggagcagatgaacgccagcatccggatggagacggaggagtcgccgaccaggacgcccggagagggggaggaggaggaagaggaggtgtccagcacggcgcccgcggtggccacgccggccgccgtggccatcaccacctccggcggcgggaaaggcagaggcaagaaggggtccaaggcgaagccgacgtgctacatgacgagcaagcggtcggagcggtgcgacgcgtcgggcgacatccgggtggacgggaaccgctccaccatctacgtcagcgggatagaccgggagtggcggaccaagccgtacgcgcgctaccacgaccccgtcgccatggcccacgtccgcgagtacaccctcaagccgctccccgtcggcgacgccgcgccggcgtgcacaaagaactactcggtcccggggttcctcttctccaacggcggcttctccggcaacctctaccacgactacaccgacgtgctggtgccgctcttcatcagcacccaccagttcaagggccgcgtgcagttcctgctctccgggatgaagccctggtgggtgggcaagttcacccccttcttccggcagctcacccggcacgacgtcatcgacgtcgacaacgaccaggaggtccactgcttcccccggatcgtggtcggcgccaccttccacaaggacatgggcgtggacccgcggcggtcgccggggcacgtctcggtggtggacttcaagcgcgcgctccgccgcgccttcgggctggggcgcgaggcggcgtcccgcggcggcgccacgggcgccggcatgccgcgcctgctcatcatctcccggcgcgggtcgcggcggttcctgaacgagcgggagatggcgcgcgcggcggcggcggccgggttcgaggtgcgcgtggcggagcccgaccagcacacggacatggcgacgttcgcgcggctggtgaactcggcggacgtgatggtggacgtgcacggcgccgggctgaccaacatggtgttcctgccccgcggcgccgtgctgatccaggtggtgcccttcggcgggctggagtggctcaccggcgtgacgttcaaggacccggcggcggacatggaggtgagctacatggactacaacgtgaggctggaggagagctcgctgatcgaccagtacccgaggaaccaccaggtgctcaccgacccctacgccgtgcacaagcagggctgggacgcgctcaagacggcctacctggacaagcagaacatccggatggacctcgacaggttcaaggccacgctgcaggaggccatgagccggctgccatgaccaccggctccgtccgggaggaggtagataggttggtgtatctatcggacggacacatctgcgcctgccttgtggtcgctcgctcaacttcgacttcttttttttttttcgagcttcgatcgatcctttttagcaagattcattggatccattgttttgttacataaaggaggatgggaaaatggtggaaggcaaaagcaagaacatgttgacatgttgtttatatactactactgtactgtagaggccagctcaatccagcccggatgatgatttgttaattgcttaatttatagaaaccctttcttttgtgatt

SEQ ID NO: 215 - protein, 486 aa, Panicum virgatum
  REGION 1..486: note = Ceres Clone ID no. 1726616
  REGION 112..353: note = Pfam Name: DUF563 Pfam Description: Protein of unknown function (DUF563)
  REGION 1..486: note = Bit score of 533.2 for HMM based on sequences of Figure 9
  REGION 1..486: note = Functional Homolog Of SEQ ID NO. 157
MKPSLRSRQEPRRVSNGVIIGAMLLSLCVLSIVKARYCATPFGKAEDQLQEQMNASIRMETEESPTRTPGEGEEEEEEVSSTAPAVATPAAVAITTSGGGKGRGKKGSKAKPTCYMTSKRSERCDASGDIRVDGNRSTIYVSGIDREWRTKPYARYHDPVAMAHVREYTLKPLPVGDAAPACTKNYSVPGFLFSNGGFSGNLYHDYTDVLVPLFISTHQFKGRVQFLLSGMKPWWVGKFTPFFRQLTRHDVIDVDNDQEVHCFPRIVVGATFHKDMGVDPRRSPGHVSVVDFKRALRRAFGLGREAASRGGATGAGMPRLLIISRRGSRRFLNEREMARAAAAAGFEVRVAEPDQHTDMATFARLVNSADVMVDVHGAGLTNMVFLPRGAVLIQVVPFGGLEWLTGVTFKDPAADMEVSYMDYNVRLEESSLIDQYPRNHQVLTDPYAVHKQGWDALKTAYLDKQNIRMDLDRFKATLQEAMSRLP

SEQ ID NO: 216 - protein, 492 aa, Zea mays
  REGION 1..492: note = Public GI ID no. 162460449
  REGION 110..354: note = Pfam Name: DUF563 Pfam Description: Protein of unknown function (DUF563)
  REGION 1..492: note = Bit score of 541.7 for HMM based on sequences of Figure 9
  REGION 1..492: note = Functional Homolog Of SEQ ID NO. 157
MKTRSSARGEPRRLGNAALLALMLCSVVALSLIRGRFAPIVTTAGDAIKSEDDAAAAALSVSKAAVNVDTGDSADEAAAEAAAEEKEKEEVQPKPADSSGSGSGGSAAKPVCYETSRRSDTCEAAGDVRVVGSTQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRSVVVGATFHRELGVDASKSPPGYSTADFRKMLRDAFGLERATATPSGDRWDIRRRPRLLIISRRPSRGRAFMNERAMADMAASLGFDVRIGEPDTSTDTSKFARLVNSCDVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 217 - DNA, 1712 bp, Panicum virgatum
  misc_feature 1..1712: note = Ceres Clone ID no. 1770027
  misc_feature 1..1712: note = Encodes the peptide sequence at SEQ ID NO. 218
  source 1..1712: mol_type = other DNA
agctggctcccttgctgagagaggaatcggccaagaagagaaggcggagaggagatgaagacccggagctccgcgaggggggagcacaggcggctcgggaatgtggctctcctggccctcatgctctgctccgtcgtcgccctctccctcatccgggggaggttcgccccaatcgtcaacagtgccggagacgccatcaaatccgaggaggcggcggccgcggtgagcaaggcggccgtcaacattgacactggcgacagcgccgacgaggccgccgcggaagctgctgcggaggagaaagacaaggaggagcccgagcccaaccccgccgccaagccggtgtgctacgagacgagccgccgctccgacacctgcgaggcggccggcgacgtgcgcgtgatggggagcagccagaccgtgtacgtcgacacgctggaccgggagtggaagaccaagccgtactgccggaagcacgacaacttcgcgctgtcccacgtcaaggagtggaccctcaagccgctcccctccggcgcggcgccgcggtgcacggtcaacagctcggccaccgccttcgtgctctccaccggcgggttcacgggcaaccctttccacgactacacggacgtgctgatcccggtcttcatcacggcgcaccccttgggcggcgaggtgcagttcttggtgagcagctacaagtcgtggtgggtgaaccggtacatccagatcttccagcagatgagccggcacgaggtggtggacatcgacgccgacgacgaggtccggtgctaccgcaacgtggtggtagggccgacgttccaccgggagctcggcgtggatgcgtccaagacgccgtcgggctactccacggccgacttccgcaagatgctgcgcgacgcgttcgggctggagcgcgcgacggccacgccgagcggcgaccagtgggacatccggcgccggccgcggctgctcatcatctcgcggcgtccctcccgcggccgcgcgttcatgaacgagcgcgcgatggcggacatggcggcgagcctcgggttcgacgtgcggatcggggagcccgacacgagcacggacacgtccaagttcgcgcggctggtgaactcgtgcgacgtgatggtgggcgtgcacggcgccggactgaccaacatggtgttcctgccggccggcgccgtggtggtgcaggtggtgccgtacgggaggctcgagtggctggcccggaacacgttcgcggagccgtcggcggggatggaggtccactacctcgagtacgcggtgcagctggacgagacgacgctgagcgagcagtacccgagcgaccacccggtgctgagggaccccatggccatccacaagcaggggtggaacgcgctcaagaccacgtacctggacaagcagaacgtgcggccgcacctggggcgcctcaagaacaccttcctccaggcgctcaagatgctgccgcacggccgggacgattaggaaggaggtgatctagacctctcggatattagagggtaggtgtatagcttaattaatggtaattactactttttttggcttgttttttcttctttatttgttcgtatgagtaagagggcgctccagtaccagcaagtagtagtggcagtgctactgtgaatgggatcgcagagacaaattctagtgtttaactgttcataagttatctttttttttcttttcct

SEQ ID NO: 218 - protein, 477 aa, Panicum virgatum
  REGION 1..477: note = Ceres Clone ID no. 1770027
  REGION 95..339: note = Pfam Name: DUF563 Pfam Description: Protein of unknown function (DUF563)
  REGION 1..477: note = Bit score of 541.9 for HMM based on sequences of Figure 9
  REGION 1..477: note = Functional Homolog Of SEQ ID NO. 157
MKTRSSARGEHRRLGNVALLALMLCSVVALSLIRGRFAPIVNSAGDAIKSEEAAAAVSKAAVNIDTGDSADEAAAEAAAEEKDKEEPEPNPAAKPVCYETSRRSDTCEAAGDVRVMGSSQTVYVDTLDREWKTKPYCRKHDNFALSHVKEWTLKPLPSGAAPRCTVNSSATAFVLSTGGFTGNPFHDYTDVLIPVFITAHPLGGEVQFLVSSYKSWWVNRYIQIFQQMSRHEVVDIDADDEVRCYRNVVVGPTFHRELGVDASKTPSGYSTADFRKMLRDAFGLERATATPSGDQWDIRRRPRLLIISRRPSRGRAFMNERAMADMAASLGFDVRIGEPDTSTDTSKFARLVNSCDVMVGVHGAGLTNMVFLPAGAVVVQVVPYGRLEWLARNTFAEPSAGMEVHYLEYAVQLDETTLSEQYPSDHPVLRDPMAIHKQGWNALKTTYLDKQNVRPHLGRLKNTFLQALKMLPHGRDD

SEQ ID NO: 219 - DNA, 1998 bp, Populus balsamifera
  misc_feature 1..1998: note = Ceres Annot ID no. 1467806
  misc_feature 1..1998: note = Encodes the peptide sequence at SEQ ID NO. 220
  source 1..1998: mol_type = other DNA
atgtccctttcaagtgcccataatttcattcatttggacaatcttcctagagctaacagaatatacgtgaggctagtgaggatgatttatgataccgtgcttgctagaagcttcagcaagcatgagcaaaagaggttgggatactgggcattgattgcttgcttgttcattgtgttgagtttcttcaccatctttaaaccttacttgggccctctacaagtttatttattcagtatgctattcgcggagttcgccatcttaactccaattggttttgcagtgaatttgaggttatcaatgggagaagacgagaaacttcatctttataatgatacaaccagctccaggctgatagccaaagaagcttatatccatatattgttgatttctgatggtgcagaaactatagacagtactttgattgtcaatgataaaagaagctcccaagaagaagcagaaattatgagtggggcattaattgtcaatgatacagatagaactcatgaagaagcagaaagtagtgttgcagaaagtataatgaatatttcttcaattgtcaatggtacgagcaactctcaagaggtatttagggaaattacaagcaaggatgatttcatggtcaacaatacaaacatctctcttccaaaagcaacagatgcagatgctgtaacaaagaacaacaaaatggagcctctatgcactatcatgggtagatcagatttctgcgagataaaaggggacatcaggattgatggaagttcctacactgtctttattgtttcatctgagactgatatcctggcagcagagaatacttcatggaggattagaccttatgcgcgaaaaggtgaccagacggcaatgggcgcggttagggaatggacactaaaacttgtggctggtggttcagatatccctcaatgcactcagaatcatagtgttccggggatccttttttcggctggtggatatgcgggaaaccattttcatgccttcactgacataattgttcccctattctcgactgctcgaccctataatggagaagtacagtttattatcaccaacggttggtctgcgtggatcgcaaagttcaaaacaatactgaaagcactgtctagatatgagctcatcaatattgataatagaaaagatatacattgctttggtagcatgacagtcggccttaaacgtccatcctacaaagagctcagtattgatccttcaaagtctccatattcaatcaaagacttcaggcagttcctgagaagttcctattctttaaagaaaacaagggcaattaaaatcagggatgggatgaagaaaaggccgaggcttctaatcatttcaagaaaaagatcgcgagcatttacaaatgttggtgaaattgttaacatggctgagagattgggtttcagagtagttgttgcagaacctggcatggatgtatcaggattttctcagatcattaattcctgtgatgtggtgatgggagttcatggtgctgggctaaccaacattgttttccttcctgaaaaggctgtcttaatccaagtaattccctttggaggagcagaatggctttcaagaactttctttgaagagcctgcaaaggacatgaacataaggtacttggactataaaatcagggtagaagagagcactttgatacagcaatacccagctgaccatgcagttttgagggatccctctgtaattgggaaacagggttggcttgcatttcagtcaatatatttacagaagcaaaatgtaacgatagatgtgaataggtttagacccactttgtcatcatggcattacagcatccccgcaagccgggctcttcttgtgcaaaaagaaggtggtaaaatccactcatgcattagcaagattgaggaggattatgagacatggggattggagaatgatggtcaattgacacctaaaacatctttaattgatgggcaattaacagccctttgggcgataggtgaataa

SEQ ID NO: 220 - protein, 587 aa, Populus trichocarpa
  REGION 1..587: note = Ceres Annot ID no. 1467806
  REGION 153..401: note = Pfam Name: DUF563 Pfam Description: Protein of unknown function (DUF563)
  REGION 1..587: note = Bit score of 836.7 for HMM based on sequences of Figure 9
  REGION 1..587: note = Functional Homolog Of SEQ ID NO. 157
MLFAEFAILTPIGFAVNLRLSMGEDEKLHLYNDTTSSRLIAKEAYIHILLISDGAETIDSTLIVNDKRSSQEEAEIMSGALIVNDTDRTHEEAESSVAESIMNISSIVNGTSNSQEVFREITSKDDFMVNNTNISLPKATDADAVTKNNKMEPLCTIMGRSDFCEIKGDIRIDGSSYTVFIVSSETDILAAENTSWRIRPYARKGDQTAMGAVREWTLKLVAGGSDIPQCTQNHSVPGILFSAGGYAGNHFHAFTDIIVPLFSTARPYNGEVQFIITNGWSAWIAKFKTILKALSRYELINIDNRKDIHCFGSMTVGLKRPSYKELSIDPSKSPYSIKDFRQFLRSSYSLKKTRAIKIRDGMKKRPRLLIISRKRSRAFTNVGEIVNMAERLGFRVVVAEPGMDVSGFSQIINSCDVVMGVHGAGLTNIVFLPEKAVLIQVIPFGGAEWLSRTFFEEPAKDMNIRYLDYKIRVEESTLIQQYPADHAVLRDPSVIGKQGWLAFQSIYLQKQNVTIDVNRFRPTLSSWHYSIPASRALLVQKEGGKIHSCISKIEEDYETWGLENDGQLTPKTSLIDGQLTALWAIGE

SEQ ID NO: 221 - protein, 505 aa, Hordeum vulgare
  REGION 1..505: note = Public GI ID no. 55792425
  REGION 117..370: note = Pfam Name: DUF563 Pfam Description: Protein of unknown function (DUF563)
  REGION 1..505: note = Bit score of 636.7 for HMM based on sequences of Figure 9
  REGION 1..505: note = Functional Homolog Of SEQ ID NO. 157
MVKGWAQRYLNLGFVAGFLLVLLTYIVVSQQFAITSPEAVNTMTTPHRKQAIQAPAAGEAGLTQEAQGEETPEAKPQDQQQPDAEPEWKQPKDTVAKEEETPKRDDTAAKPIDNGKVVCTTEGPFSDTCDVFGDVRTNGTAHTVTLVPATETESQEWKIQPYARRGMSGISEFTVMQLDSTSAASPAPACTVTHRVPAIVFALGGLTGNYFHDFSDALVPLFVASRRYGGEVQLLASNIQPWWLGKYEAVVRKLSKYDVVDLDHDDQIRCFPNVTVGLRMHKEFDITPELVPGGVPLSMVDFTAFLRETYSLPRAAPISLMKDISPPEDQEKRKPRLMLLHRGHYRKLVNVPEIVKAAEKAGFEVAIADPRFDVRVEELARSVNSFDVLLGVHGAGLTNAVFLPTAAVVIQVVPYGNLERMAKVDFGDPVADMGLRYLEYSITAEESTLLEMLGPDHPVIKDPESVHRSGWDKVAEYYLGKQDVRVDVDRFAPTLALAIEHLRQK

SEQ ID NO: 222 - protein, 484 aa, Saccharum officinarum
  REGION 1..484: note = Public GI ID no. 56409862
  REGION 102..346: note = Pfam Name: DUF563 Pfam Description: Protein of unknown function (DUF563)
  REGION 1..484: note = Bit score of 527.2 for HMM based on sequences of Figure 9
  REGION 1..484: note = Functional Homolog Of SEQ ID NO. 157
MKTRSSARGEPRRLGNAALLALMLCSVVALSLIRGRFAPIGDAIKSEDDAAAAAVAVSKVAINVDTGDGADEAAVEAAAEEKQKEEVQPKPADGSGGGAAKPVCYETSRRSDTCEAAGDVRVVGSSQTVYVDLLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRSVVVGPTFHRELGVDASKSPSGYSTADFRKMLRDAFGLERATATPSGDRWDIRRRPRLLIISRRPSRGRAFMNERAMADMAASLGFDVRIGEPDSSTDTSKFARLVNSCDVMVGVHGAGLTNMVFLPAGAVVVQVVPYGRLEWLARNTFAEPSAGMEVHYLEYVVQMDETTLSEQYPSDHPVLRDPMAIHKQGYRALNRTYLDKQNVRPHLGRLKNTFLQALKMLPHGRDD

SEQ ID NO: 223 - protein, 500 aa, Oryza sativa
  REGION 1..500: note = Public GI ID no. 115482674
  REGION 107..360: note = Pfam Name: DUF563 Pfam Description: Protein of unknown function (DUF563)
  REGION 1..500: note = Bit score of 527.1 for HMM based on sequences of Figure 9
  REGION 1..500: note = Functional Homolog Of SEQ ID NO. 157
  source 1..500: note = Oryza sativa subsp. japonica
MKTRSSGRGGGEPRRRLRNAAVMALMLSSLVALSLVRARFSPIASDGGEALKLKADESKLVVTTNHAVVNTESGDSSSSSSSAAAEEEEEVAAPAKPAAAGGGGARPVCYETSRRSDTCEAAGDVRVVGGSQTVYADTLDREWKTKPYCRKHDAFALSHVKEWTLRPLPSGDGGGGGAAVAPRCTTNSTATAFVLSTGGFTGNPFHDYTDVLIPAFITAHRFGGEVQFLVSSYKSWWMNKYIQIFQQMSRHDVVDVDADGDEVRCYRSAVVGPEFHRELGVDPTKTPSGYSVLDFRKMLRGAFGLDRATATPSGDRWDIRRRPRLLIISRRAARGRAFMNERAMADMAASLGFDVRVGEPDASTDTSKFARLVNSCDVMVGVHGAGLTNMVFLPAGAVLVQVVPYGKLEWLARNTFAEPSSAMEIHYLEYAVQLDETTLSEQYPADHPVLRDPMAIHKQGWEALKTTYLDKQNVRPHLGRLKNTFLQALKLLPHDKETMN

SEQ ID NO: 224 - DNA, 1771 bp, Triticum aestivum
  misc_feature 1..1771: note = Ceres Clone ID no. 815962
  misc_feature 1..1771: note = Encodes the peptide sequence at SEQ ID NO. 225
  source 1..1771: mol_type = other DNA
cactggagctggcgaagatcgaagccggtgcgagagcaggagccgggtgcgagatgaaggccgggagcaacgagagcagtaagaagctcgtgagcggaggggcgctcgcggtgtggctcctgctccctctcgtcgtcctcgtcgtcctcaagaccgattgcctgccgcaggttacagtacgacaactctttgcacagttcagcttcacccaacctgcagcagatgattcggttaacaaggttccgtcttcaggcacagaaagtgtagcgcagcaagaagcagttgacgtagccaggttaaaagccgcgcatgatccggtcgtcggagcgccacctcctctcgcgtcaagtaacgagatggccgccggcgtcgccgatgccaccagagatctcaaaaatcaaacggagttgcttgccatgaacggtgtgagagacggttctggggtaaattcagatgtggcagcaccaagaagcaagctaagttgcaacttcagcttttatcgcatgaacatctgcgccatggaaggcgacgtccgtacgcacggcaaggccgccaccgtctacgtggtctcgccatccgacgacagctaccggccggagaacgggacggtcacgatccgcccgtacccgcgcaagtgggagaagccaacgatgcagctggcccgagaggtgaccatccgctcgagcggcccgggtgccacggacatgtccccgccacgctgcacggtgacgcacgacgtccccgcggtggtcttctccaccggcggctacagcagcaacttcttccacgccgtgacggacattgtcatccctctctacaacacggcgcgggagtacgacggccgcgtccagctcgtggtcaccgactacagccgcaagtggatcgccaagtaccggcacgtcctcgccgcgctctccgcctatccggtcatcgatttcgacgccgacgacaacgtgcgctgcttcccgaaggtgcacgtcggcatcgagagccacaaggagctagggatcaaccccgttctctcccacaagggctacacgctgatggacttccgggacttcctgcggtcggcctactcgctgaagcgcgcgtggtcgacgcccgtcaaccggatctccggcggcaggcctcgcctcgtcatgctgctgcggcgccactcgagggcgttcacgaacgacgcggaggccgtcgcggccgccacggaggtcggcttcgaggtggtggcggcggggccggaggccgtgcgcgacatggcccacttcgcggaggtggtaaactcgtgcgatgtgatggtgggcgtgcacggcgccgggctcaccaacatggtcttcctcccgcacaacggcacggcgatgcagatcatcccgtggggcgagatgaagtggccgtgctggagcatcttcggcgagacggtgcctgacatggggctccggtacgtcgagtacgaggcgaccgccgaagagacgacgctcaaggacgtgtacccgagggaccaccccgtcttcaccaaccccgtctccatacacaaacaggggttcgaccagctgtggaagatcttcctcgatggtcagaacgtcacccttgacatcaatcgcttcacgggggtcatgcagcaaatctaccaggacgtcaccgttacatagatgtagagactacgtacgtccgctgccctgatgctatgcgcatcactgtgtaatttttgctctttgctgctttgtttctactccctccgtcacaaaatgtaagatcatattttacaccatatgatgtt

SEQ ID NO: 225 - protein, 529 aa, Triticum aestivum
  REGION 1..529: note = Ceres Clone ID no. 815962
  REGION 142..394: note = Pfam Name: DUF563 Pfam Description: Protein of unknown function (DUF563)
  REGION 1..529: note = Bit score of 515.4 for HMM based on sequences of Figure 9
  REGION 1..529: note = Functional Homolog Of SEQ ID NO. 157
MKAGSNESSKKLVSGGALAVWLLLPLVVLVVLKTDCLPQVTVRQLFAQFSFTQPAADDSVNKVPSSGTESVAQQEAVDVARLKAAHDPVVGAPPPLASSNEMAAGVADATRDLKNQTELLAMNGVRDGSGVNSDVAAPRSKLSCNFSFYRMNICAMEGDVRTHGKAATVYVVSPSDDSYRPENGTVTIRPYPRKWEKPTMQLAREVTIRSSGPGATDMSPPRCTVTHDVPAVVFSTGGYSSNFFHAVTDIVIPLYNTAREYDGRVQLVVTDYSRKWIAKYRHVLAALSAYPVIDFDADDNVRCFPKVHVGIESHKELGINPVLSHKGYTLMDFRDFLRSAYSLKRAWSTPVNRISGGRPRLVMLLRRHSRAFTNDAEAVAAATEVGFEVVAAGPEAVRDMAHFAEVVNSCDVMVGVHGAGLTNMVFLPHNGTAMQIIPWGEMKWPCWSIFGETVPDMGLRYVEYEATAEETTLKDVYPRDHPVFTNPVSIHKQGFDQLWKIFLDGQNVTLDINRFTGVMQQIYQDVTVT

SEQ ID NO: 226 - protein, 491 aa, Sorghum bicolor
  REGION 1..491: note = Public GI ID no. 56409860
  REGION 108..353: note = Pfam Name: DUF563 Pfam Description: Protein of unknown function (DUF563)
  REGION 1..491: note = Bit score of 532.1 for HMM based on sequences of Figure 9
  REGION 1..491: note = Functional Homolog Of SEQ ID NO. 157
MKTRSSARGEPRRLGNAALLALMLCSVVALSLIRGRFAPIGSTAGDAIKSEDDAAAAAVAVSKAAAVNVDTGDGADEAAAEAAAEEKDKEEVQPKPAADGSRGGAAKPVCYETSRRSDTCEAAGDVRVLGSSQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRNVVVGPTFHRELGVDASKSPSPGYSTADFRKMLRDAFGLERATATPSGDRWDIRRRPRLLIISRRPSRGRAFMNERAMADMAASLGFDVRIGEPDSSTDTSKFARLVNSADVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 227 - DNA, 1476 bp, Sorghum bicolor
  misc_feature 1..1476: note = Ceres Annot ID no. 8670072
  misc_feature 1..1476: note = Encodes the peptide sequence at SEQ ID NO. 228
  source 1..1476: mol_type = other DNA
atgaagacccggagctcagcgagaggggagccgaggcggctcgggaatgcggctctcctggcgctcatgctctgctccgtcgtcgcgctctccctcatccgggggaggttcgccccaattgttaccaccgcaggagacgccatcaaatccgaggacgacgctgctgcagcggcggtggcggtcagcaaggcggctgctgtcaacgttgacaccggcgacggcgccgacgaggccgccgctgaagctgctgctgaggagaaagacaaggaggaggtccagccgaagccagccgccgacggttcccgcggcggcgcagccaagccggtgtgctacgagacgagccgccgctccgacacctgcgaggcggctggcgacgtgcgcgtgttggggagctcccagacggtgtacgtcgactcgctggaccgggagtggaagaccaagccgtactgccggaagcacgacaacttcgcgctcgcccacgtcaaggagtggtccctcaagccgctcccctccggcgctgcgccgcagtgcacggtgaacagctcggccaccgcgttcgtgctctccacgggcggcttcacgggcaacccgttccacgactacacggacgtgctgatcccggccttcatcacggcgcacccgctccgcggcgaggtccagttcctggtcagcagctacaagtcgtggtggatgaaccgctacatccagatcttccagcagatgagccggcacgaggtggtggacatcgacgccgacgacgaggtccgctgctaccggaacgtggtggtggggccgacgttccaccgtgagctcggcgtggacgcgtccaagtccccgtcgccggggtactccacggccgacttccgcaagatgctgcgcgacgcgttcgggctggagcgcgccacggccacgcccagcggcgaccggtgggacatccggcgccggccgcggctgctcatcatctcgcgccgcccgtcccgcgggcgcgccttcatgaacgagcgcgccatggcggacatggcggcgagcctcgggttcgacgtgcggatcggggagcccgacagcagcaccgacacgtccaagttcgcgcggctggtgaactcgtgcgacgtgatggtgggcgtccacggcgccgggctcaccaacatggtgttcctgccggccggcgccgtggtggtgcaggtggtgccgtacgggcggctggagtggctggcccggaacacgttcgcggagccgtcggcggggatggaggtccactacctggagtacgtggtgcagctggacgagacgacgctgagcgagcagtacccgagcgatcacccggtgctgagggaccccatggccatccacaagcaggggtggaacgcgctcaagaccacgtacctggacaagcagaacgtgcgcccgcacctgggccgcctcaagaacaccttcctacaggcgctcaagatgctgccgcacggccgggacgattga

SEQ ID NO: 228 - protein, 491 aa, Sorghum bicolor
  REGION 1..491: note = Ceres Annot ID no. 8670072
  REGION 108..353: note = Pfam Name: DUF563 Pfam Description: Protein of unknown function (DUF563)
  REGION 1..491: note = Bit score of 535.2 for HMM based on sequences of Figure 9
  REGION 1..491: note = Functional Homolog Of SEQ ID NO. 157
MKTRSSARGEPRRLGNAALLALMLCSVVALSLIRGRFAPIVTTAGDAIKSEDDAAAAAVAVSKAAAVNVDTGDGADEAAAEAAAEEKDKEEVQPKPAADGSRGGAAKPVCYETSRRSDTCEAAGDVRVLGSSQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRNVVVGPTFHRELGVDASKSPSPGYSTADFRKMLRDAFGLERATATPSGDRWDIRRRPRLLIISRRPSRGRAFMNERAMADMAASLGFDVRIGEPDSSTDTSKFARLVNSCDVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 229 - DNA, 1617 bp, Populus balsamifera
  misc_feature 1..1617: note = Ceres Annot ID no. 1473327
  misc_feature 1..1617: note = Encodes the peptide sequence at SEQ ID NO. 230
  source 1..1617: mol_type = other DNA
atgatgaatgataatttacttaccagaagctttagcaagcatgagcgaaagaaattggggtatggggcgttggctgcgtgcttgctcattacgttgagttttttcatcgtctttaacccttatttgggtcctctaccacttttgaatttcatgctatcaacgggggatgatcagaaactatttgctgtaaatgacacaagtagctctttgcaaatggacaaaggtctattcgttatttattttgaggatgcagaaattattacaatcaatgatgcaagcagctctcaggaggcagtagctagggatgcagaaatggttagaaatgaaaagaaattgatcaatgatactggcagctccaggcaaacaatcaatgaaattgtgattaaagattccctgatagtcaatgatacaagtagctctcagcaaatagctactgatgcagatgctgcaacaatgaatgaaaagatcgagctgcgctgcaatatcatgggaagatcagagttctgcgagataaaaggggacatcaggattgatggaaattcctccactgctttcattgtctcatctgaaaccgatatcttgacagcagaaaacacctcatggagtattaggccttatgcgcgaaaagaagctctaggggaaaaggattttgctaggaaatggtcagtaaaacttgtaactgatcgcccagatatccctcgatgcactcgtaatcacagtgttcctgcaatccttttctctgttgggggatattcaggaaactttttccatgccttcactgatataattgtcccactatactcaactgctcaaccttttaatagagaagtacaatttctcattaccaacagaaaatcttcgtggattgcaaagttcaaaacattattggaggcactgtctagatatgagatcatagacatcgatgacagacatgatatgcattgcttccagagcctaacaattggccttaaaggtcgaaacaacaaagagctcagtatcgattcttccacctctccatattctatgaaggacttcacgcagtttttaagaagatggtattccttaaagaaaataacagcagccaaaatcagggatggcgataagagaaagcctcggcttctaatcatttcaagaaagagatcaagagctttcacaaatgttggtgaaattgctgaactggcagaaagcttgagctaccaagtaattgtcgcagagcctgggccagatgtatcaggatttgcaaaaatcatcaactcttgtgatgtagtgatgggagttcatggtgctggcctaaccaacattgttttccttcctgaaaatgcaatcttgattcaagtagttccatttggaagggtagaatgggcgtcaagagtctcctttgaagaccctgcaaaggacatgaacataaggtacttggactacaaaattaaggtagaagagagcactttgatacagcaatacccagccgaccatgtagttttaagggatccctctgtaatcgggaaacagggttggttggcatttcgttcaatatacttggacaagcaaaatgtaacgctagatgtgaataggtttagacccactttggtaaaagctttagaacttttgcatcagtga

SEQ ID NO: 230 - protein, 488 aa, Populus trichocarpa
  REGION 1..488: note = Ceres Annot ID no. 1473327
  REGION 108..356: note = Pfam Name: DUF563 Pfam Description: Protein of unknown function (DUF563)
  REGION 1..488: note = Bit score of 747.8 for HMM based on sequences of Figure 9
  REGION 1..488: note = Functional Homolog Of SEQ ID NO. 157
MLSTGDDQKLFAVNDTSSSLQMDKGLFVIYFEDAEIITINDASSSQEAVARDAEMVRNEKKLINDTGSSRQTINEIVIKDSLIVNDTSSSQQIATDADAATMNEKIELRCNIMGRSEFCEIKGDIRIDGNSSTAFIVSSETDILTAENTSWSIRPYARKEALGEKDFARKWSVKLVTDRPDIPRCTRNHSVPAILFSVGGYSGNFFHAFTDIIVPLYSTAQPFNREVQFLITNRKSSWIAKFKTLLEALSRYEIIDIDDRHDMHCFQSLTIGLKGRNNKELSIDSSTSPYSMKDFTQFLRRWYSLKKITAAKIRDGDKRKPRLLIISRKRSRAFTNVGEIAELAESLSYQVIVAEPGPDVSGFAKIINSCDVVMGVHGAGLTNIVFLPENAILIQVVPFGRVEWASRVSFEDPAKDMNIRYLDYKIKVEESTLIQQYPADHVVLRDPSVIGKQGWLAFRSIYLDKQNVTLDVNRFRPTLVKALELLHQ

SEQ ID NO: 231 - DNA, 1853 bp, Panicum virgatum
  misc_feature 1..1853: note = Ceres Clone ID no. 1726182
  misc_feature 1..1853: note = Encodes the peptide sequence at SEQ ID NO. 232
  source 1..1853: mol_type = other DNA
actattttgtgcgtcagtttgtagtctgtagctgaagatttttgcccaagatggcctgtgagaagaagagtgcaagcagttttgccgtcaaggttggattggtacttcttgcgggatgcattcttgcgccaatttcactggcgacaatgttccggaattatgcggttcctctgcaaacattgagcttattgttttcagtaggttctgcttcctcagtaatggggggaggggaaaggattgcctctcatcgttcaggcagaaacgaagggcccgtgctgtgcgacttttcgagctcgagatcagacgtgtgcgagctgagaggcgacgtccgcgtcctccccaacgccaccatcgtgctccaccatcccctggcgaggcatcaatcatggcggatgaagccgcacgccaggaagagcgaccgccacgcgctcgcccgcgtcactgaggtgacggtcgcatcgtcgcacgccgcggaccacgccgctccccggtgcacggccaaccacaccgccccggccgtcgtcttctcggccggcggctacgcggggaacatgttccacgacctgaccgacgtccttgtcccgctgttcatcaccacgcgccggttcggcggcgacgtgcacctcctcgtcagcgacgccccgccgtggtggctcgacaagttccggccgctgctccgcgggctctcccgccacgacgtcgtcgacatggacagaggcggcaggggcgtgctctgctacccgcgcctggtcgtcggcctcgagttccacaaggagatgagcgtcgacgccgcgaggaccgccggcgagtactccatggccgacttcgccctcctcgcccggcgatcctacggcctcactcgggacacggccatccggctccgcggccgctcctccggcttccgccccaggctgctcctcatctcacggaggtcgaccagggcgttcaccaacgccggcgccatcgcgcgggccgccacggccctggggtacgaggtggtggtgggcgagccggcgcggcacgcggagctgccgtcgttcgcgcgggtggtgaactcgtgcgacgtgctggtgggcgtgcacggcgccgggctggcgaacctggtgttcctcccggcgggcgccgtggtggtgcaggtggtgccgctgggcgggctggacgccatggccgccgaggacttcggcgagccggcgcgcgacgcggggctccgatacgtgcactaccgcgtcgccgtggcggagagcacgctggcgaggcggtacccgcgcgaccaccgcgtgctgagggaccccgcggcggtgcggcgggaggggtggatggcgctgcgggcggcgtacctcgtcggccagaacgtgacgctcgacgtccgccggttcggcggcgccctgcgacgcgccatggagcttctccgctagacggacatcgtagacagaacagggggcctcctgggccaggtgcaaggaccgcacgctgcgcaggaacgaagtctcaagaacgactccatcgagatcttcaacgcgacaacgcctcaacggcaccgtcaccggcggcgcctgacgcgatgaacaggttgttcgatctgcaatcctgcattgagatttcaggagttatcctctgtcgttctgtttcgtttcggctactcctcgatgaatgggcggctgacagtgatggaatgatcgtatagtacgtgtatgtaaaactcagagaaaaatgtaatgcagtacagtacagaagcatgccatcggttgaaacgaaaactgaagtttctcatggttcagacttcgacatgtttgccagcttcactggcttcccgatcaatcctaagaaatgaagcattgcttcgatttcaatcg

SEQ ID NO: 232 - protein, 454 aa, Panicum virgatum
  REGION 1..454: note = Ceres Clone ID no. 1726182
  REGION 75..321: note = Pfam Name: DUF563 Pfam Description: Protein of unknown function (DUF563)
  REGION 1..454: note = Bit score of 480.4 for HMM based on sequences of Figure 9
  REGION 1..454: note = Functional Homolog Of SEQ ID NO. 157
MACEKKSASSFAVKVGLVLLAGCILAPISLATMFRNYAVPLQTLSLLFSVGSASSVMGGGERIASHRSGRNEGPVLCDFSSSRSDVCELRGDVRVLPNATIVLHHPLARHQSWRMKPHARKSDRHALARVTEVTVASSHAADHAAPRCTANHTAPAVVFSAGGYAGNMFHDLTDVLVPLFITTRRFGGDVHLLVSDAPPWWLDKFRPLLRGLSRHDVVDMDRGGRGVLCYPRLVVGLEFHKEMSVDAARTAGEYSMADFALLARRSYGLTRDTAIRLRGRSSGFRPRLLLISRRSTRAFTNAGAIARAATALGYEVVVGEPARHAELPSFARVVNSCDVLVGVHGAGLANLVFLPAGAVVVQVVPLGGLDAMAAEDFGEPARDAGLRYVHYRVAVAESTLARRYPRDHRVLRDPAAVRREGWMALRAAYLVGQNVTLDVRRFGGALRRAMELLR

SEQ ID NO: 233 - DNA, 1500 bp, Sorghum bicolor
  misc_feature 1..1500: note = Ceres Annot ID no. 8734902
  misc_feature 1..1500: note = Encodes the peptide sequence at SEQ ID NO. 234
  source 1..1500: mol_type = other DNA
atgaagtcgaaccggaacctgtcaagggcggaggggaggaggctggggaatgtggcactcatcgccttcatgctcggatccctcctgctgctctccctcatcagggccaagttctccccgattggtaaaacaggggacgccatcaaagcagaggagcagcaggcaatggcgaaagacagcgtcgagatggcgaacgcgcatgacgctgcagctgcagccgaggaggaaggcgaggagactcggtccaaccccaccgactccaactctggcagcggcagcggcggcggcggcgtgagcggcacggccattgtggtcggcgacgaccacaccgagagggcgagcaaaagcaagccggtgtgctacgagtcgagccggcggtcggacacctgcgaggcggccggcgacgtgcgcgtggtggggcgtgcccagacggtgctggtgagccctctggagcgggagtggaaggtgaagccttactgccggaagcacgacgcgttcgcgctgtcccacgtcaaggagtggacgctccgtccggtgggaagcgacgacgcgccgcggtgcacggtgaacagctcggcgacggcgttcgtgctgtcgacgggcgggttcacgggcaacctgttccacgactacacggacgtgctgatcccggcgttcatcacggcgcggcggtacgccggcgacgtgcagctgctggtgagcagctacaagccgtggtggaccaccaagtacctgcaggtgctgcagcagctgagccggcacgaggtggtggacgcggacgcggacgccgaggtccgctgctacccgcgcgtcgtggtaggcccgacgttccaccgcgagctaggcgtggacgcgtcctcctcgtcgccgtccatgccggagttccgcgcgatgctgcgggacgcgttcgggctagagcgcgcggcggcggcgccgagcggggaccggtgggacatccgccggcgcccgcgcctcctcatcatctcgcggaggacctcgcggcggctgctgaacgagcgcgccatggcggacatggcgacgagcctggggttcgacgtgcggacgggggacccggaggtgagcacggacgtggggcggttcgcgcggctggtgaactcggcggacgtgatggtgggcgtgcacggcgacgggctcaccaacatggtgttcctccccgccggcgccgtgctggtgcaggtggtgccgtacggcgggctggagtggctggcgcgcggcacgttccgggagcccgcggaagggatggaggtgcactacctcgagtacgtggtgcagaaggacgagacgacgctgagcgaggagtacggcgaggacgatccggtgatcagagaccccgccgccatccataagcaggggtgggacgcgctcaaggccgtgtacctcgacaagcagaacgtccggccgcacctcggcaggctcaagaacaccttcgtgcaggcgctcaagctgctgccccatggacggcaggtcgccgacgactga

SEQ ID NO: 234 - protein, 499 aa, Sorghum bicolor
  REGION 1..499: note = Ceres Annot ID no. 8734902
  REGION 118..358: note = Pfam Name: DUF563 Pfam Description: Protein of unknown function (DUF563)
  REGION 1..499: note = Bit score of 545.9 for HMM based on sequences of Figure 9
  REGION 1..499: note = Functional Homolog Of SEQ ID NO. 157
MKSNRNLSRAEGRRLGNVALIAFMLGSLLLLSLIRAKFSPIGKTGDAIKAEEQQAMAKDSVEMANAHDAAAAAEEEGEETRSNPTDSNSGSGSGGGGVSGTAIVVGDDHTERASKSKPVCYESSRRSDTCEAAGDVRVVGRAQTVLVSPLEREWKVKPYCRKHDAFALSHVKEWTLRPVGSDDAPRCTVNSSATAFVLSTGGFTGNLFHDYTDVLIPAFITARRYAGDVQLLVSSYKPWWTTKYLQVLQQLSRHEVVDADADAEVRCYPRVVVGPTFHRELGVDASSSSPSMPEFRAMLRDAFGLERAAAAPSGDRWDIRRRPRLLIISRRTSRRLLNERAMADMATSLGFDVRTGDPEVSTDVGRFARLVNSADVMVGVHGDGLTNMVFLPAGAVLVQVVPYGGLEWLARGTFREPAEGMEVHYLEYVVQKDETTLSEEYGEDDPVIRDPAAIHKQGWDALKAVYLDKQNVRPHLGRLKNTFVQALKLLPHGRQVADD

SEQ ID NO: 235 - DNA, 1431 bp, Sorghum bicolor
  misc_feature 1..1431: note = Ceres Annot ID no. 8741882
  misc_feature 1..1431: note = Encodes the peptide sequence at SEQ ID NO. 236
  source 1..1431: mol_type = other DNA
atggggaggcatgagggtaccaagaaaagcagcagcagtgcaggaagggctgcgatgtggctcctgctgcctcctcttcttgtggtgattgtgctgaagactgatttcctgccgcaggtcgctcgctgtttcgagaatgcaagatggcagcaacatccacattacccagaagctgtaaaagactacaaccaacaaaatcagatccttaccacgaacgggccaaaagacagctcttcaataaattcagacttgggagcccctgtcagcaagttaacctgcaacttcagcaaccctcactcggacacctgcacaatggaaggtgacttgcgcatccacggcaaatcggcgacagtctatgtcgtcgcggcgtccacccacagaccggagaattctaccttcatagtccgcccatacacgcgaaagtgggagcaagagaccatgtcgaggattcgggaggtcaccatgagatccatgccgccagctttcagcttcattatcccacccaagtgcacggttaggcacgacgtgccggcggtggtcttctctaccggtggctgcggtggaaacttcttccacgccatgagcgacctcatcgtgccactctacatcacatcccgtgagtacaatggccacgtccagtttcttatcaccgactacagacctgaatgggttgccaagttcaggccaatcctcgccgcactgtccatgtacccggtcatcgacttcgacgccgacaccgccgtgcgctgcttcccgtcagcgcatgtcgggttgcagagtcacaacaagatgcttgcgatcgacccgagtctttcccggaatggttacactatgatgggattccgagacttcctcaggtctgtcttctcgctgcaacggccatgggttgaacccgttagcaggagctcagggcggcagaagcctcggctcgtcatggttctgcggcggcactcaagggagctgacgaacgaagctgaaaccatcaccgccatggaagacctcggcttcgaagtagtcgcggcgttgccagaggatgttagggatatgggccacttcgccggggtggtgaactcctgcgacgtgatggttggagtgcatggtgctgggctgaccaacatggtgttcctgcctcacaatggcaccgtagtgcagattgttccctggggtgacatgaagtgggcgtgctggtatgactttggtgagcctgtgccaggcatgggactccggtacgtcgagtatgaggtcacggcagaggaaaccacactgaaggagaagtacccaagggatcaccctgtgtttaccgacccccggtctatacatcgccagggtaaagcttggtcgacattcctgaatggccagaacattactctagacatcgaccggttcagagcggtgatgcaacaggtgttccaatccatcacgatagagtag

SEQ ID NO: 236 - protein, 476 aa, Sorghum bicolor
  REGION 1..476: note = Ceres Annot ID no. 8741882
  REGION 91..343: note = Pfam Name: DUF563 Pfam Description: Protein of unknown function (DUF563)
  REGION 1..476: note = Bit score of 481.0 for HMM based on sequences of Figure 9
  REGION 1..476: note = Functional Homolog Of SEQ ID NO. 157
MGRHEGTKKSSSSAGRAAMWLLLPPLLVVIVLKTDFLPQVARCFENARWQQHPHYPEAVKDYNQQNQILTTNGPKDSSSINSDLGAPVSKLTCNFSNPHSDTCTMEGDLRIHGKSATVYVVAASTHRPENSTFIVRPYTRKWEQETMSRIREVTMRSMPPAFSFIIPPKCTVRHDVPAVVFSTGGCGGNFFHAMSDLIVPLYITSREYNGHVQFLITDYRPEWVAKFRPILAALSMYPVIDFDADTAVRCFPSAHVGLQSHNKMLAIDPSLSRNGYTMMGFRDFLRSVFSLQRPWVEPVSRSSGRQKPRLVMVLRRHSRELTNEAETITAMEDLGFEVVAALPEDVRDMGHFAGVVNSCDVMVGVHGAGLTNMVFLPHNGTVVQIVPWGDMKWACWYDFGEPVPGMGLRYVEYEVTAEETTLKEKYPRDHPVFTDPRSIHRQGKAWSTFLNGQNITLDIDRFRAVMQQVFQSITIE

SEQ ID NO: 237 - DNA, 1725 bp, Triticum aestivum
  misc_feature 1..1725: note = Ceres Clone ID no. 761431
  misc_feature 1..1725: note = Encodes the peptide sequence at SEQ ID NO. 238
  source 1..1725: mol_type = other DNA
ccattattcactggactggagcgaggtagctaccaagtgatcaagccagtacctacgtacgcacgcacaagagcgagatgaaaaggggcgggaggaacgagagcggcaagaagcttgtgagcggaggaggagcggccgccgtcgcgtgtctcctgcttcctctcgtcgtcctcgccgtcctcaagtccgacttcatgccgcagcaggtcgttcacattgcagagacgagcattggcgaagctggtgtagagggtgcaatatggcagccgcggcaacaactagtagccaagtcaaaagctggacatgatccggtcgtcgaagcacccccttctccggcgtcgggcgacgagacgcccgacaaggtcgtcgatgcaaacagagctctcaaaaatgggaaggggttcctggccgcggacgtgggaatggatggttctttgataaaatcagatgctgatgtagccgcaccaaggagcaagttaagttgcaacttcagcagtcatcgcacgagcatgtgtgccatgcaaggtgacgtccgtatgcacggcaaaaccgccaccgtctacgtcgtctcagcgtccgacgacaaccggccagacaatgggacgatcacgatccgcccgtacccgcgcaaatgggagacaccgacgatgcaacttgtccgtgaggtgaccatccgttggagagccccaccgggaccgggtgcgccgcggtgcacggtgacctacgacgtcccagcggtggtcttctccaccggtggctacggcgtcaacatcttccacgccatcaccgacatcattatgcctctctacaacacagcgcgggagtacgatgggcgcgtccggctcgtggccacaaactacgaccgcaaatggatcaccaagtaccgtcacgccctctccatgctctccatctacccgatcattgacttcgacgccgacaacgaggtgcgctgcttcccgtcggtgcatgtgggaacggagagccataaggaactagggattgactcggctctctccggcaagggctacacgatgatgggcttccgcagcctgctccggtcggcttactctctgaagcgtgagtgggtgacccccataaagagtggaaggcctcgtctcgtcatggtgctgcggaggaactcgagggcgctgacgaacgaggcggaagttatagcagctgccaccgaggttggcttcgaggtggtagccgcggggccggaggtggtgcgcgacctgggaaagttcgcggagacggtgaactcgtgcgacgtgttggtgggtgtgcacggcgcggggctgagcaacatggtgttcctcccgcgcaacggcacggtggtgcagatcgtcccttggggcgagatgaagtggccggcctggacctcctacggcgagccggtggctcccatggggcttcggtacgtggagtacgaggtgaccgccgaggagacgacgctcaagtacgtgtacccgaggaaccacaccgtcttcacggatcccgtctccctacacaaacagggattcaacatgttgtgggagaccttcctcaacgggcagaatgtcaccctcgacatccaacgcttcacaggggtcctgcaacacatctaccgctccgttaccatcacatcataagtagattacgtccgaggtttttgattttcttttcaaaaatgtaataacacgtcgattccatacctcacactggctcagcaatggctctggccctcac

SEQ ID NO: 238 - protein, 516 aa, Triticum aestivum
  REGION 1..516: note = Ceres Clone ID no. 761431
  REGION 134..380: note = Pfam Name: DUF563 Pfam Description: Protein of unknown function (DUF563)
  REGION 1..516: note = Bit score of 508.1 for HMM based on sequences of Figure 9
  REGION 1..516: note = Functional Homolog Of SEQ ID NO. 157
MKRGGRNESGKKLVSGGGAAAVACLLLPLVVLAVLKSDFMPQQVVHIAETSIGEAGVEGAIWQPRQQLVAKSKAGHDPVVEAPPSPASGDETPDKVVDANRALKNGKGFLAADVGMDGSLIKSDADVAAPRSKLSCNFSSHRTSMCAMQGDVRMHGKTATVYVVSASDDNRPDNGTITIRPYPRKWETPTMQLVREVTIRWRAPPGPGAPRCTVTYDVPAVVFSTGGYGVNIFHAITDIIMPLYNTAREYDGRVRLVATNYDRKWITKYRHALSMLSIYPIIDFDADNEVRCFPSVHVGTESHKELGIDSALSGKGYTMMGFRSLLRSAYSLKREWVTPIKSGRPRLVMVLRRNSRALTNEAEVIAAATEVGFEVVAAGPEVVRDLGKFAETVNSCDVLVGVHGAGLSNMVFLPRNGTVVQIVPWGEMKWPAWTSYGEPVAPMGLRYVEYEVTAEETTLKYVYPRNHTVFTDPVSLHKQGFNMLWETFLNGQNVTLDIQRFTGVLQHIYRSVTITS

SEQ ID NO: 239 - DNA, 1566 bp, Sorghum bicolor
  misc_feature 1..1566: note = Ceres Annot ID no. 8678791
  misc_feature 1..1566: note = Encodes the peptide sequence at SEQ ID NO. 240
  source 1..1566: mol_type = other DNA
atggggtcgcccaaggcggccaagagcatggtgaagcagcgcatctggcgtcaccggctcgtcgcaccgttcgctgccgttcttgtcacggccgtcctcgccgtcgtcgtattctccggcctgttcgcgcaggatccaaacgccaccccggagttcactgctgtaaatgtgggcaacacccggccagtgcgcgataagtcggagttcacagcagccagtggatctcccaacaaggaggatcttgcaacatcggcatctgatcaagaattggatgatggaaattctgagcccaatcaagcttcccaaggcaccgtgcctgcaacaggggagggagggacagcaacggcagtgccgacccaaagagaaagaagcactggaggatctggtttagttcagtacacaacatgcacacctcgaactagaacaaccatctgtgatctctccaaccaacgcttcgacatctgtgagctttgtggtaatgctcgcaccattggccgctcctccactgtaatgtatgtcccacagtcccttacttccaatggagaagagtggaatattccagcacagtcacggaaaagccttccatggatcaagaaggtgactgtcaaaaccctgaaggcttcccaacaggtgccaagatgcacatccaggcatgccataccagccattgtctttgcattgggcgggtttacagcgaatgtctggcatgatgtcagtgatgttcttgtccctctgtttcttactgcccagcagtttgaccgagatgtccaattacttatcaccaataatcagccctggttcatcaagaaatactcagcaatctttcatcgcctcacaagacacaacattattgattttgatgcagacgatgaggtcaggtgctatccacatgtcattgttgggctgaggagccaccgggatcttggtattgatccaaactctacaccgcagaactacacaatgatggatttccgtttgtttgtccgtgaagcctatggattacctgcgcctgaagtggatataccatacagggttgacaaagatgaccctgaaaagaagcccaggataatgctcattgaccgaggcaagacacgaaggttcatgaatatgcctgatgttttacgagggcttgattggtttggtttcgaggtggtcagggcagatccaaggattgattctactcttgatgaatttgtccgcctagttgattcatgtgatgcaatgatgggtgttcacggtgcgggcttgactaacatggtgttcctgaggtcaggtgcagtggtggtgcacattgtaccctatggggttgagttcatggctaatggattctacggtgcacctgcaagggacatgggcctcagacacgtgcagtacagcatcagtccagatgagagcacactactggagaagtatggcgagaaccatatggtgattaaagatccagaagccataaggaacagtggatgggagaaggttggggagttgtatatgaccaaacaggacgttgtgctcaatatgacgaggtttgggcctagtttgttgaaggcaatagagttcattgtgtag

SEQ ID NO: 240 - protein, 521 aa, Sorghum bicolor
  REGION 1..521: note = Ceres Annot ID no. 8678791
  REGION 143..389: note = Pfam Name: DUF563 Pfam Description: Protein of unknown function (DUF563)
  REGION 1..521: note = Bit score of 431.1 for HMM based on sequences of Figure 9
  REGION 1..521: note = Functional Homolog Of SEQ ID NO. 157
MGSPKAAKSMVKQRIWRHRLVAPFAAVLVTAVLAVVVFSGLFAQDPNATPEFTAVNVGNTRPVRDKSEFTAASGSPNKEDLATSASDQELDDGNSEPNQASQGTVPATGEGGTATAVPTQRERSTGGSGLVQYTTCTPRTRTTICDLSNQRFDICELCGNARTIGRSSTVMYVPQSLTSNGEEWNIPAQSRKSLPWIKKVTVKTLKASQQVPRCTSRHAIPAIVFALGGFTANVWHDVSDVLVPLFLTAQQFDRDVQLLITNNQPWFIKKYSAIFHRLTRHNIIDFDADDEVRCYPHVIVGLRSHRDLGIDPNSTPQNYTMMDFRLFVREAYGLPAPEVDIPYRVDKDDPEKKPRIMLIDRGKTRRFMNMPDVLRGLDWFGFEVVRADPRIDSTLDEFVRLVDSCDAMMGVHGAGLTNMVFLRSGAVVVHIVPYGVEFMANGFYGAPARDMGLRHVQYSISPDESTLLEKYGENHMVIKDPEAIRNSGWEKVGELYMTKQDVVLNMTRFGPSLLKAIEFIV

SEQ ID NO: 241 - DNA, 1972 bp, Triticum aestivum
  misc_feature 1..1972: note = Ceres Clone ID no. 845464
  misc_feature 1..1972: note = Encodes the peptide sequence at SEQ ID NO. 242
  source 1..1972: mol_type = other DNA
atcaacgcggcctcggaagctgccgtgctgtctccggcgaaatttatctgagtgggcgactgcatcagccgtccgtccccggccaatcggcggcgagggggcagcggccagtgggtcgttggcctggggcggtggtccagcatcacaggagctagtagccgctgccctgcccgccgtagtggttgccgtgccgggtccctcaggtcaggtagagccacacccaccacggccggcgcgcgcgcgacgcgagcccaccaaccaacctccgggcctgaacctcctccgcgcgctacatcgccatcgcctccaccaaccacgcctttaatacccttgcgccgcacagctcccccgcccgcgctgcgctgtcgctgctgtggcttccggtcgatccccggcccgccgtgccaagccatctccacctccaccaccggcgggcaggcgccatgaagcagccgaggtcgcggcaggagccgcgccggatgggcaactcggccatggtggtcaccatgctgctctccctctgcgtcctcaccttcatcaaggcccgctactgctccaccccgtaccccaacaagccggcgccgctgctggacctggaggtggagatcgacgaggactacgacagcagccggtacaagatctccggccccatcggggaggaggagttcgaccccagccgccccacctgctacaacaccagcaagcgctcggagcggtgcgcggccgtgggcgacgtccgggtcgacggcaaccactccaaaatctacatcagcccgctgggcaaggagtggcgcaccaagccgtacgcgcgccgccacgacgccgtcgccatggacgacgtccgcgagttcgcgctgttccccttcggcggcgccaacgacagcgccgtgccgccgctctgcaccaggaaccactccgtcccggccttcctcttctccagcggcgggttcgcgggcaacctgtaccacgactacaccgacgtgctggtgccgctcttcaccagcacccaccacttcggcggcgaggtgcagttcctgctcacagacatcaaggactggtggctggacaagttcacgccgctcttccgccagctctccaactacgacgtcatcgacgtggacaacgaccaggaggtgcactgcttctcgcgcatcgtcatcggctccaccttccaccggcccatgggcatcgacggcacgcgctcctcgggcggcgagaccgtggccgacttcaagcgcctgctccggcgcgccttccggctcgaccgcgtggtggcgtcccacgacggggccgccagcctcggcaagccgcggctcctcatcatctcccgcaagtcctcccggcggttcctgaacgagcgcgccatggcgcacgcggcggcggcggcgcagttcgacgtgcgcatcgcggagccggacaaccacacggacatgcccaacttcgcgcggctggtgaactcggcggacgtgatgatgggggtgcacggcgccgggctgaccaacatggtgttcctcccgagccgcgccgtgctgctgcaggtggtgccgttcggcgggctggagtggctgtcccgggtgaccttcaaggacccggccaaggacttcgacgtgacctacatggagtacaacgtgtcgctggaggagagctcgctcaaggacctctaccccaaggaccatttctacctgcagcacccctacgacgtgcacaagaagggctggaacgccatcaagaccacctacctcgacaagcagagcgtccggctcgacctcgccaagctcacgcgcacgctccagcacgcgcgcagcctcctgccctccccctcctcgcactgacactgagcccctgcttcaagttcggtttctccatgctagattaggccttcttcttcctcctcatcctctctctccctcccatgtttggttcacttcttgatttgttgttgtggtggtgccaaagattcatttctttcttt

SEQ ID NO: 242 - protein, 462 aa, Triticum aestivum
  REGION 1..462: note = Ceres Clone ID no. 845464
  REGION 80..324: note = Pfam Name: DUF563 Pfam Description: Protein of unknown function (DUF563)
  REGION 1..462: note = Bit score of 406.1 for HMM based on sequences of Figure 9
  REGION 1..462: note = Functional Homolog Of SEQ ID NO. 157
MKQPRSRQEPRRMGNSAMVVTMLLSLCVLTFIKARYCSTPYPNKPAPLLDLEVEIDEDYDSSRYKISGPIGEEEFDPSRPTCYNTSKRSERCAAVGDVRVDGNHSKIYISPLGKEWRTKPYARRHDAVAMDDVREFALFPFGGANDSAVPPLCTRNHSVPAFLFSSGGFAGNLYHDYTDVLVPLFTSTHHFGGEVQFLLTDIKDWWLDKFTPLFRQLSNYDVIDVDNDQEVHCFSRIVIGSTFHRPMGIDGTRSSGGETVADFKRLLRRAFRLDRVVASHDGAASLGKPRLLIISRKSSRRFLNERAMAHAAAAAQFDVRIAEPDNHTDMPNFARLVNSADVMMGVHGAGLTNMVFLPSRAVLLQVVPFGGLEWLSRVTFKDPAKDFDVTYMEYNVSLEESSLKDLYPKDHFYLQHPYDVHKKGWNAIKTTYLDKQSVRLDLAKLTRTLQHARSLLPSPSSH

SEQ ID NO: 243 - DNA, 2056 bp, Panicum virgatum
  misc_feature 1..2056: note = Ceres Clone ID no. 1726076
  misc_feature 1..2056: note = Encodes the peptide sequence at SEQ ID NO. 244
  source 1..2056: mol_type = other DNA
gcaagcaaatgccgcgaagaggaggacgcgtgtagtagccgtcgcatactcgcatgtgaagcaggggccttgcccaattctcaagtagctgaaggagaaagaagaggccaggttgggcgatcgaggcggccggtcaggggatgggcaccgactcgccgtcgccgtcgacggcgccggtggccggcctcggggccaagggcgcggcgagggcggtggcgcagcaccaccaggccgtggtcgggttcctcctcggcttcttcctcgtcctgctgctctacaccaccgtttcctcccagttcggttcgcagaacgccattggtgtcctacagtctacgtcgacgtcgccggccgtgcgtacgggtcaaaacgccatgactccaacgtcgccatcgccgaagccgaacgacgtgaaaaaaggagatcatatcaaggaagacaataaagagcaacaaagcaatacacctaacaagatggaggaggatcgtacccaacatggtatcaatggaatcgaaaaggaaaatcaaactgaagccaaattggatgatgagaaagtgaaaaatccagagggaggtcaagcagcagtgaacgatgcaagaagtgacaggatggaggaggaagatcttatccggcaagaaatcgatcaaggcagcatgatcaagaatgataccaacatcggacaagttacgccacgcaagccaatctgcgacctctccgatcccagatacgacatctgcgagatctccggcgacgctcgcgccctgggagccaaccgcaccgtcctctacctcccgccggccggcgagcgcggcgcggacagccaggagtggagcatccgggaccagtcacgcaagtacctcgagttcgtgggcaacgtcaccgtcaggtcgctgaacgcctcccaggctgcggcggcgccggcgtgcacctcccggcacgccgtcccggccgtggtgttcgccatgaacgggctcacgtccaacccctggcacgacttcagcgacgtgctcatccccctcttcctcaccacgcgcgcgctggacggcgaggtccagttcctcgtctccgacctccagccgtggttcgtggacaagtaccggctcatcctccgcaacctctcccgccacgacgtcgtcgacttcaaccgggacggcggcgtccggtgctacccgcgcgtcaccgtcggcctccgcagccaccgcgacctcggcatcgaccccgcgcgcgcgccgcggaactacaccttgctcgacttccagctctacgtccgcgagatctacgggctgccgccgccgggcatcgacgtcccgtacaaggagcagcagcagcggaccatgccacggctgatgctgataaaccgtggccggacgaggaagttcgtcaacttcccggagatcgtcgcggcggcgcgggacgccgggttcgaggtggtgcccgtggagccgcgccgggacctcggcgtggaggagctcgcccgggcggtggactcgtgcgacgtgctcatgggcgcgcacggcgccgggctgaccaacttcttcttcctccggagcaacgcggtgatgctgcaggtggtgccgtgggggcacatggaacactcgtgcatggtgttctacggcgggccggcgagggagatgcggctgcgggacgtcgagtacagcatcgccgccgtggagagcacgctctacgataagtacggcgaggatagcccggtgatcagcgacccggagtcgatacacagacaagggtggcagtttgggatgaggtattactggatcgagcaggacatcaggctcaacgtcacaaggtttgctcccaccctgcaccaggtgctccagatgctcaaggaatagcaataggaggggggaattaaaagaaatatatggacagttagattattattacattacatccatgcttaattagaggggagatgtataggatgaagctttttacatttgttgtgatgatcatcattcgtcttctttctagattaatctgatggccaccaaaacctcccaatatgtgtgaacagattaccaaataaagaagattgtttccc

SEQ ID NO: 244 - protein, 568 aa, Panicum virgatum
  REGION 1..568: note = Ceres Clone ID no. 1726076
  REGION 186..434: note = Pfam Name: DUF563 Pfam Description: Protein of unknown function (DUF563)
  REGION 1..568: note = Bit score of 438.8 for HMM based on sequences of Figure 9
  REGION 1..568: note = Functional Homolog Of SEQ ID NO. 157
MGTDSPSPSTAPVAGLGAKGAARAVAQHHQAVVGFLLGFFLVLLLYTTVSSQFGSQNAIGVLQSTSTSPAVRTGQNAMTPTSPSPKPNDVKKGDHIKEDNKEQQSNTPNKMEEDRTQHGINGIEKENQTEAKLDDEKVKNPEGGQAAVNDARSDRMEEEDLIRQEIDQGSMIKNDTNIGQVTPRKPICDLSDPRYDICEISGDARALGANRTVLYLPPAGERGADSQEWSIRDQSRKYLEFVGNVTVRSLNASQAAAAPACTSRHAVPAVVFAMNGLTSNPWHDFSDVLIPLFLTTRALDGEVQFLVSDLQPWFVDKYRLILRNLSRHDVVDFNRDGGVRCYPRVTVGLRSHRDLGIDPARAPRNYTLLDFQLYVREIYGLPPPGIDVPYKEQQQRTMPRLMLINRGRTRKFVNFPEIVAAARDAGFEVVPVEPRRDLGVEELARAVDSCDVLMGAHGAGLTNFFFLRSNAVMLQVVPWGHMEHSCMVFYGGPAREMRLRDVEYSIAAVESTLYDKYGEDSPVISDPESIHRQGWQFGMRYYWIEQDIRLNVTRFAPTLHQVLQMLKE

SEQ ID NO: 245 - DNA, 1396 bp, Zea mays
  misc_feature 1..1396: note = Ceres Clone ID no. 240112
  misc_feature 1..1396: note = Encodes the peptide sequence at SEQ ID NO. 246
  source 1..1396: mol_type = other DNA
agatcccctcacagtcatcctccacccaccccacccaccgcctccgcctctctctctctctcgtttgttcgtctcggcttccggtcgccgattcttctctgcgcaaaagattcctggtggtggtgcccgtaccttgctccacgcctcgctcgcgtcgcgtgcatggggctggacgtcggcggcatcgggatgggcctggatctgggtctggacctcgggctgttcgccgcgcggagcgccggagggatggcggccgcggccaagggtgcgccggcggagatcgagtcctgcatcaggagcctcgaggaggagcgccggaagatcgaggtgttcaggcgcgagctcccgctctgcgtgcgtctcctcgccgatgtaatcgacgaattgaaggatgaggccgccaagagaggcggagacgcggaggccaaggccgacgacggcgataagcggaaatggatgagcaccgctcagctgtggctcgacagcgacgccaaatccgacgagtctgacaaagagcaactgagtgaaatcacttcgccggagcccaagttgctcggtggcgcacccatgcccataagggccgttgcggcggtgccacccctgccgcctccattcttcaggagagaagacagctctgccggcagtggtctgtcgctggtaccacccgcagctaagccgccgattcctcccatgtctgccagcgacaacgcgagcggcagattctgtgccactatgccaccgtctggctctggggccaacttgcactctcaggctcagcagcaagccaggaaggcgaggcggtgctggtcgccggagcttcaccggctgtttgttgccgccttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgctggcgggcggcctctgggctcctcctcatcaggagcaaagcagctcgcagtccgggtctccccagggcccgcttcagttctctggatccggtgtagcggccaccgtcggcggcgatagcagcagcagcgacgaggacgacaagtccgaaggctacagccggaaatacgtgtaaaggccgcgttcgacggatgagagtgtagagatagcgtcgcggcttctgcttgcccgtctgtggcaataacagattcatcagtcttgagagaggttgtagtgcgtgcgcccaagagctcaactgatcatgggttggattgtttgtttgtcatgtacgtacatggaaagctgatggcttcctgacttttaatttctgggcaggtcccaaaattttcgac

SEQ ID NO: 246 - protein, 338 aa, Zea mays
  REGION 1..338: note = Ceres Clone ID no. 240112
  REGION 1..338: note = Ceres Seed Line no. Pv00460
  REGION 212..263: note = Pfam Name: Myb_DNA-binding Pfam Description: Myb-like DNA-binding domain
  REGION 1..338: note = Bit score of 801.3 for HMM based on sequences of Figure 3
  REGION 1..338: note = Figure 3
MGLDVGGIGMGLDLGLDLGLFAARSAGGMAAAAKGAPAEIESCIRSLEEERRKIEVFRRELPLCVRLLADVIDELKDEAAKRGGDAEAKADDGDKRKWMSTAQLWLDSDAKSDESDKEQLSEITSPEPKLLGGAPMPIRAVAAVPPLPPPFFRREDSSAGSGLSLVPPAAKPPIPPMSASDNASGRFCATMPPSGSGANLHSQAQQQARKARRCWSPELHRLFVAALHQLGGPQVATPKQIREVMKVDGLTNDEVKSHLQKYRLHNRRSPGVVAPVSQSVMLAGGLWAPPHQEQSSSQSGSPQGPLQFSGSGVAATVGGDSSSSDEDDKSEGYSRKYV

SEQ ID NO: 247 - DNA, 1517 bp, Panicum virgatum
  misc_feature 1..1517: note = Ceres Clone ID no. 1791988
  misc_feature 1..1517: note = Encodes the peptide sequence at SEQ ID NO. 248
  source 1..1517: mol_type = other DNA
aatccagatcctccagtcgcccacccacccacccacccaccgctttctcctctcccttccttccttcctacctttccctgttcgtgttcgtctcggcttccggtcgctgattccgcggcggagattctgtggtggcggtgctcgttcgctctcgcgcttggggttcgcgtgtgcatggggctcgacgtggcggagatcgggatgggcctggacctggggctcgacctcaggctcttcgccgcgcggagcgccgtcgggatggcggcggccgcggccaagggcgcgcccgcggggatcgaggcctgcatcaggagcctcgaggaggagcgccgcaagatcgaggtcttcaggcgcgagctcccgctctgcgtccgcctcctcgccgacgtgatcgaggagttgaaggaagaggccgcgaggaaaggcggcgatttggagttaaggccggacgacggcgacaagaggaaatggatgagcaccgcgcagctttgggtggactccgacgccacatccaagtccgagaaagagcaaccaagtgagatgacctcgccggagcccaagttgctcggtggccccatgccgatacgggctgttccggtggtgccgccgccgcctccaccgggcttcaggagggatgacaacgctgccggaactgcgaggctgcccggtctgtcgttgctgccaccggctgcaaagacatcggtctctccggtccctgccgttgatgaacaccggcagaacgccgccgcaagattgtctgccaccatgtcaccatctggctctggactcaacctgcatactcagactcaacagcagcaacagctggcgaggaagacaaggcggtgctggtcgccggagcttcaccggcagtttgttgctgccttgcatcaactcggcggccctcaagttgctactccgaagcagatcagagaggtgatgcaagtggacgggcttacaaacgacgaagtgaaaagccatctccagaagtaccggctgcacaacagaagatcgcccggcatggctcccgtgagccagtcgattgtgctggtgggtggcctctggagttctcaggagcaaagcagctcacagtcacagtcagggtctcctcagggcccccttcagttctctgggtcagggatggccgtctctgcagccaccgtcggcggcgacagcagcagcagcgacgaagatgacaagtccgatgaaggctacagccggaaatgattgcaaggctgcgtttgcagaagatcggttgagagtgtagaggtagcatcgcggctttgcgcatcggtggcaataacaggttcatcagtcagggagaggctgtagtgcagccaggccatgcacgcagggagattgggcggtgagtgctcaagagatgaactgatcatgagtttggttgttggttgtcatgtacatgaaaagctgataccagttttcatgaggcttcttgactttagttcccgggcagatccaaattttcgccctgagaattatatacatgcaagattattcac

SEQ ID NO: 248 - protein, 349 aa, Panicum virgatum
  REGION 1..349: note = Ceres Clone ID no. 1791988
  REGION 222..273: note = Pfam Name: Myb_DNA-binding Pfam Description: Myb-like DNA-binding domain
  REGION 1..349: note = Bit score of 802.1 for HMM based on sequences of Figure 3
  REGION 1..349: note = Functional Homolog Of SEQ ID NO. 246
  REGION 1..349: note = Figure 3
MGLDVAEIGMGLDLGLDLRLFAARSAVGMAAAAAKGAPAGIEACIRSLEEERRKIEVFRRELPLCVRLLADVIEELKEEAARKGGDLELRPDDGDKRKWMSTAQLWVDSDATSKSEKEQPSEMTSPEPKLLGGPMPIRAVPVVPPPPPPGFRRDDNAAGTARLPGLSLLPPAAKTSVSPVPAVDEHRQNAAARLSATMSPSGSGLNLHTQTQQQQQLARKTRRCWSPELHRQFVAALHQLGGPQVATPKQIREVMQVDGLTNDEVKSHLQKYRLHNRRSPGMAPVSQSIVLVGGLWSSQEQSSSQSQSGSPQGPLQFSGSGMAVSAATVGGDSSSSDEDDKSDEGYSRK

SEQ ID NO: 249 - DNA, 1026 bp, Sorghum bicolor
  misc_feature 1..1026: note = Ceres Annot ID no. 8632546
  misc_feature 1..1026: note = Encodes the peptide sequence at SEQ ID NO. 250
  source 1..1026: mol_type = other DNA
atggggctggacgtcggtgagatcgggatgggcctggatctgggtctcgacctcaggctgttcgccgcgcggacagccggcgggatggcggcggccgcggccaagggtgcgccggcggggatcgagtcctgtatcaggagcctcgaggaggagcgcaagaagatcgaggtgttcaggcgcgagctcccgctctgcgcgcgcctcctcgccgacgtgatcgacgagttgaaggaggaggccgccaagagaggcggaggagacgcggacgcgaaggcggacgacggcgacaagcggaaatggatgagcaccgctcagttgtgggtggacagcgaagccaaatcggacgagtctgataaggagcatcagagtgaatcacctcgccggagcccaagttgcttgtggccacccatgcccataagggccgttgcggctgtaccacccctgccgccgccgttcttcaggagagaagacagctctgccggcacttgtctgtcgttggtatcgccggcatctaaggccccgatttctcccgtggctaccagcgataacgccagcggcagattttgtcccaccatgccaccatctggctcttctggggtcaccttgcactctcaggctcagcagcaggctagcaggaaggcgaggcggtgctggtcgccggagcttcaccggcagttcgtcgccgctttgcatcaactcggcggccctcaagttgctactccgaaacaaatcagggaggtgatgcaagtggacggtcttacaaatgatgaagtgaaaagccatctccagaagtaccggctgcacaacagaagatcccccggtgttgctccggtgagccagccgatcatgttggtgggtggcctctgggctccacaggagcaaagcagctccggttcaccccagggtccgcttcagttctcgggatcaggtgtggccatttctacggccaccgtcggcggtgacagcagcggcagcagcagcgacgaagacgacaagtccgaaggctacagccggaaatgcgtgtaa

SEQ ID NO: 250 - protein, 341 aa, Sorghum bicolor
  REGION 1..341: note = Ceres Annot ID no. 8632546
  REGION 215..266: note = Pfam Name: Myb_DNA-binding Pfam Description: Myb-like DNA-binding domain
  REGION 1..341: note = Bit score of 795.4 for HMM based on sequences of Figure 3
  REGION 1..341: note = Functional Homolog Of SEQ ID NO. 246
  REGION 1..341: note = Figure 3
MGLDVGEIGMGLDLGLDLRLFAARTAGGMAAAAAKGAPAGIESCIRSLEEERKKIEVFRRELPLCARLLADVIDELKEEAAKRGGGDADAKADDGDKRKWMSTAQLWVDSEAKSDESDKEHQSESPRRSPSCLWPPMPIRAVAAVPPLPPPFFRREDSSAGTCLSLVSPASKAPISPVATSDNASGRFCPTMPPSGSSGVTLHSQAQQQASRKARRCWSPELHRQFVAALHQLGGPQVATPKQIREVMQVDGLTNDEVKSHLQKYRLHNRRSPGVAPVSQPIMLVGGLWAPQEQSSSGSPQGPLQFSGSGVAISTATVGGDSSGSSSDEDDKSEGYSRKCV

SEQ ID NO: 251 - protein, 348 aa, Oryza sativa
  REGION 1..348: note = Public GI ID no. 115455537
  REGION 226..277: note = Pfam Name: Myb_DNA-binding Pfam Description: Myb-like DNA-binding domain
  REGION 1..348: note = Bit score of 759.8 for HMM based on sequences of Figure 3
  REGION 1..348: note = Functional Homolog Of SEQ ID NO. 246
  REGION 1..348: note = Figure 3
  source 1..348: note = Oryza sativa subsp. japonica
MGLDVGEIGMGLDLSLDLKMFAARSAVRMAAAAAKEATGVEACIRSLEEERRKIEMFRRELPLCARLLADVIELMKEEAGKRRKDGDDAEAKAEDGDKTKWMSTAQLWVDSRGSDADSENDRRSGSTSPASRLLGGAEESSSRAVAPPPYFRREERVVLRPAMPLLPPASHRSPPPAAAAAATAAGDDHRHVVASSFATAVPSPVPAALSLQAQAQQQQQQARKSRRCWSPELHRQFVAALQQLGGPQVATPKQIREVMKVDGLTNDEVKSHLQKYRLHNRKSPGTASASHSIVLVGDLWASQEVSCSQSGSPQGPLQLSGSGVAVSAATAGDSCCEDDDKSEGYVRK

SEQ ID NO: 252 - protein, 406 aa, Populus trichocarpa
  REGION 1..406: note = Public GI ID no. 118486821
  REGION 263..314: note = Pfam Name: Myb_DNA-binding Pfam Description: Myb-like DNA-binding domain
  REGION 1..406: note = Bit score of 990.5 for HMM based on sequences of Figure 3
  REGION 1..406: note = Functional Homolog Of SEQ ID NO. 246
  REGION 1..406: note = Figure 3
MGSLSSELSLDFARPSTAKALPFLPKTIADFLKEVSVIGDSAVKVLKVDGFIKDLEEEKRKIDAFKRELPLCMLLLNDAIQVLREELMQLGASKNQQPVLEEFIPLKKNIDDHHENDGLIEEKDSKDKKNWMSSVQLWNADDHHPSTDYLFDPKQNLKLESKTNKKGNQYGNEDAFQAGIGRTAARTFMPFKACSGLSSKEEKLPVPSLSLSTPGIKSLKEESNSTGSRSSCSRSVSTISGPNSDSNLRNGPQSQQQTARKQRRCWSPELHRRFVNALQQLGGSQAATPKQIRELMQVDGLTNDEVKSHLQKYRLHTRRVTPATAAAPANQSVVVLGGLWMTQDQYGDSSKATSSQSGSPQGPLQLAVNTGGTSTTGGDSMEDDEDAKSEGYSWKSHSHRSGKDDV

SEQ ID NO: 253 - DNA, 1609 bp, Glycine max
  misc_feature 1..1609: note = Ceres Clone ID no. 537690
  misc_feature 1..1609: note = Encodes the peptide sequence at SEQ ID NO. 254
  source 1..1609: mol_type = other DNA
tttcgttctgaaatttccttcacatccawcccactttccttttctctctccctctcttattatttattttttcattcattcatttcgctctctctctcccccttctcctttcttcctctgcaaccaaaatctgaatcttagggcaccaacacctttgatccaatgggttcggttgccgcagaagaactgaacttagatttaagatcctccttcgtccccaaaaccatcaccgatttcctccgccacctctccgccaacaacaaccaccctgccaccctccgcgatttcctctcccgcctcgaagacgagctccgcaagatccacgccttcaaacgcgaactccccctctccatgctcctcttaaacgacgcaatttccgttctgaaggttgaatcgcagaaatgctgcagggtggcgcgcgattcgccgccggtgctggaggagttcattccgttgaagaaggagcttggtgatcagagcgaggaggaggaggagaatgatgatgacaaggacgataacgaatgcagggataagaggaattggatgagttccgttcagctctggaataacaacactaccaccactactactaataacaacaacaatgcctctgatcgcaaacaactacttcataaattacaaaccaagaaaagtgaagaagggcagtctgtggctgaggatccttttcagacttgtagtaatagaaatgggggaagaagggcatttatgcctttctctaggtactcttcttcatcatcatctgtgccggtgacaacagtggggctgggggctgcatccaaagaagagaaggaagagagtgttaggaataggctttctcttctgacgccttctgtgaaagaagggtgtggttcaaggggatcaaggagcagttctaacagggctgtttcttcttctcctcccacggctcagccgggtttgcgtgcgacttcgcttcagcagactgctaggaaacagaggaggtgctggtcccctgagttgcacagacgattcgttaatgccttgcagaagcttggaggttctcaagcagctacaccaaagcaaattagagagcttatgcaggttgatggcctaactaacgatgaagtgaagagccatttacaaaaataccgacttcatacgcggagagttcctgctgcaagttctaatcagccagttgtggttcttggaggtttgtggatgtctcaagatcagtacaatgactcttcaaaagttagcagttcagggtcaggttctcctcaaagtcctcttcatttggctgcagggtcccggggagggacatctcctactgaaggtgacagcatagaagatgatgaagatgcaagatccgagagttatagttggaaaagtcatatgaacaaaccaggaaaagttgatgtataggatactactctccaccatgaattttgcagataaaagtatacatgggaggagttttaccactacataagaataatactacatgatacataaaaaagagggtcaacgataagaggcagttgtagtttttttttaaggtttagctttgccttatatactgcgtgagttttgatatgagactccgaattaaaatatcattttccttcgcttt

SEQ ID NO: 254 - protein, 412 aa, Glycine max
  REGION 1..412: note = Ceres Clone ID no. 537690
  REGION 272..323: note = Pfam Name: Myb_DNA-binding Pfam Description: Myb-like DNA-binding domain
  REGION 1..412: note = Bit score of 1000.3 for HMM based on sequences of Figure 3
  REGION 1..412: note = Functional Homolog Of SEQ ID NO. 246
  REGION 1..412: note = Figure 3
MGSVAAEELNLDLRSSFVPKTITDFLRHLSANNNHPATLRDFLSRLEDELRKIHAFKRELPLSMLLLNDAISVLKVESQKCCRVARDSPPVLEEFIPLKKELGDQSEEEEENDDDKDDNECRDKRNWMSSVQLWNNNTTTTTTNNNNNASDRKQLLHKLQTKKSEEGQSVAEDPFQTCSNRNGGRRAFMPFSRYSSSSSSVPVTTVGLGAASKEEKEESVRNRLSLLTPSVKEGCGSRGSRSSSNRAVSSSPPTAQPGLRATSLQQTARKQRRCWSPELHRRFVNALQKLGGSQAATPKQIRELMQVDGLTNDEVKSHLQKYRLHTRRVPAASSNQPVVVLGGLWMSQDQYNDSSKVSSSGSGSPQSPLHLAAGSRGGTSPTEGDSIEDDEDARSESYSWKSHMNKPGKVDV

SEQ ID NO: 255 - DNA, 1203 bp, Arabidopsis thaliana
  misc_feature 1..1203: note = Ceres Annot ID no. 880540
  misc_feature 1..1203: note = Encodes the peptide sequence at SEQ ID NO. 256
  source 1..1203: mol_type = other DNA
atcttgtccgatggttcaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcgacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttg

SEQ ID NO: 256 - protein, 356 aa, Arabidopsis thaliana
  REGION 1..356: note = Ceres Annot ID no. 880540
  REGION 212..263: note = Pfam Name: Myb_DNA-binding Pfam Description: Myb-like DNA-binding domain
  REGION 1..356: note = Bit score of 808.9 for HMM based on sequences of Figure 3
  REGION 1..356: note = Functional Homolog Of SEQ ID NO. 246
  REGION 1..356: note = Figure 3
MVQTETDQRMGLNLNLSIYSLPKPLSQFLDEVSRIKDNHSKLSEIDGYVGKLEEERNKIDVFKRELPLCMLLLNEAIGALKDEARKGLSLMASNGKFDDVERAKPETDKKSWMSSAQLWISNPNSQFRSTNEEEEDRCVSQNPFQTCNYPNQGGVFMPFNRPPPPPPPAPLSLMTPTSEMMMDYSRIEQSHHHHQFNKPSSQSHHIQKKEQRRRWSQELHRKFVDALHRLGGPQVATPKQIRDLMKVDGLTNDEVKSHLQKYRMHIRKHPLHPTKTLSSSDQPGVLERESQSLISLSRSDSPQSPLVARGLFSSNVGHSSEEDEEEEDEEEEKSDGRSSCRNDETKKKRQVLDLEL

SEQ ID NO: 257 - DNA, 1310 bp, Triticum aestivum
  misc_feature 1..1310: note = Ceres Clone ID no. 797459
  misc_feature 1..1310: note = Encodes the peptide sequence at SEQ ID NO. 258
  source 1..1310: mol_type = other DNA
atcccacacgccccacccctattccgccgcctcccttctctcttctcctcactccctctcgccgcagagaagatggcgtccgacggcagcggcgttgtcacggtgtacggcagcggcaacaacggcgccggtacgcagctggagcccaagtcgtccccgttctctgtcaaggtgggcctggcccagatgctccgcggcggcgtcatcatggacgtcgtcaacgccgagcaggcgcgcatcgccgaggaggccggcgcctgcgccgtcatggcgctcgagcgcgtccccgccgacatccgcgcccagggcggcgtcgcccgcatgtccgacccgggcctcatccgcgaaatcaagcgcgccgtcaccatccctgtcatggccaaggcccgcatcgggcacttcgtcgaggcccagatcctcgagtccatcggcgtcgactacgtggacgagagcgaggtcctcacgctcgccgacgacgcccaccacatcaacaagcacaacttccgcgtccccttcgtctgcggctgccgcaacctgggcgaggccctccgccgcatccgcgagggcgccgccatgatccgcaccaagggcgaggccggcaccggcaatgtcatcgaggccgtccgccacgtccgctccgtcatgggcgacgtgcgtgccctccgcagcatggacgacgacgaggtattcacctatgccaagagcatcgccgcaccgtacgacctcgtcatgcagaccaagcagctcggccgcctgcccgtcgtccagttcgccgccggcggggtcgccacgccggccgatgcggccctcatgatgcagctcggctgcgacggtgtcttcgtcggctccggtgtcttcaagagcggcgaccccgcgcgccgcgcgcgcgccatcgtgcaggccgtcacccactacagcgaccctaatgtgctcgccgaggtgagctgcgacctcggtgaggccatggtgggcatcaacctctccgatcccaaggtcgagcgctttgcggcgcgctccgagtgatctttgttggccaccgtcaataccagctcccaaaataatactccatggatcaatgataaggacaaaaaagaagtacttagaaacgattcctagttattatcatgtgatttcttcatgatgatcattctagctccgataacaattcaagcggtagcaagcatgcacctccagtcagtcagtcggtcagtcgctcgctttatatatgtacacacatgttgtcgtcttccatttcatttctgttgttgttaacacaagttaagtatccatccatccttttcctccgtgtt

SEQ ID NO: 258 - protein, 348 aa, Triticum aestivum
  REGION 1..348: note = Ceres Clone ID no. 797459
  REGION 223..274: note = Pfam Name: Myb_DNA-binding Pfam Description: Myb-like DNA-binding domain
  REGION 1..348: note = Bit score of 756.7 for HMM based on sequences of Figure 3
  REGION 1..348: note = Functional Homolog Of SEQ ID NO. 246
MGLDVAEIGMGLDLGLDLRLFAARSAGGMAAAAAKGAPAGIEACIRSLEEERRKIEVFRRELPLCVRLLADVIEELKEEAARKGGDSELRPDDGDKRKWMSTAQLWVDSDATSKSEKEQRNEVTSPEPKLLGGPMPIRAVPAVPLPPPPCFRKDDNASGTAGLPGLSLLPLAAKTSVSPVPAVDEHRQNAGAARLSATMSPSGPGLNLHAQTQQQQQQARKTRRCWSPELHRQFVAALHQLGGPQVATPKQIREVMQVDGLTNDEVKSHLQKYRLHNRRSPGVAPVSQSIVLVGGLWGSQEQSSSQSGSPQGPLQFSGSGTAISAATVGGDGSSSDEDDKSDEGYSRK

SEQ ID NO: 259 - DNA, 1411 bp, Triticum aestivum
  misc_feature 1..1411: note = Ceres Clone ID no. 630408
  misc_feature 1..1411: note = Encodes the peptide sequence at SEQ ID NO. 260
  source 1..1411: mol_type = other DNA
agttcacatccacctcatactttctcttgcaacaagtcagtaaagattccgtttggagagcgagagcgagagctccggtgtaaaatcgatgggtctggacgtaggagagatcggcatgggcgcagatttgagcctggatttgaagatgttcgcggccaagagcctggggcgggtcagggaagcgccggcggccgccatggacgactgtatccggaggctggaggaggagaagagcaagatcgaggtgttccggcgcgagctccccctctgcgcgcgcctcctcgccgacgtgattgatgtgatgaagaaggaggtggaggagaagaagagaggcggcgatcgaggagaggacagggaggacgccggcgcaggcgacaagagcaactggatgagcaccgcgcagctctggaccggcgattccgtccggggggacgatgcttccgagaagcaggatgagaggaggaggtcgtcggagccggaatctcgcgacggcgctggcttgccgtccaaggccgtgggctccggcgcgccggcgttcgcgccgccgagtttgaggaaggatgacaaggctgtgcggatgccggatctgccgtttctgtcgccggcaccgatcaagacctctccggctgctgctaccggcggcgctgaagaaagccgccgccagcttgttggattcgcgcaagaagcggcgagggctgcagccgccctggcaccggctgccccttccctaagcctccaggcgcagtcgcagcagacagcacagcagcagcagcagcaagcgaggaaggcgcggcggtgctggtcgccggagctgcacctccagttcgtcactgccctgcaccaactcggtggtccccaagttgctactccaaagcaaatcagggagctgatgaaggtggatggcctgaccaatgatgaagtgaagagccatctccagaaataccgtctgcacaaccgaagggcgccaggatctccggcagccaaccggccgatcgtgctcatgggagggctctggataactcaggagcagagcagctcccagtcagggggatcacctccggggcccctaaacttctcaagctcaggcgtagctgcctcatcggtgacggtcagcggcgaggaggaagatggcagatccgagagctatggctggaaatgatcaacaagttatattagtgtttgttcagagatttccatggcgcgcgatgacagtggtatcttgagagattcctgagacaggattatagtgtagtcttttttgttgtatgcagggtgatcaagccttgagtgctttgagatgaaactcttgctgttattatgtaagtacatcgggaagaggttataccagttacaattttgcggatatgttaatctaaaaaggttggggcagagctacaattttcgcccagag

SEQ ID NO: 260 - protein, 356 aa, Triticum aestivum
  REGION 1..356: note = Ceres Clone ID no. 630408
  REGION 235..286: note = Pfam Name: Myb_DNA-binding Pfam Description: Myb-like DNA-binding domain
  REGION 1..356: note = Bit score of 471.4 for HMM based on sequences of Figure 3
  REGION 1..356: note = Functional Homolog Of SEQ ID NO. 246
MGLDVGEIGMGADLSLDLKMFAAKSLGRVREAPAAAMDDCIRRLEEEKSKIEVFRRELPLCARLLADVIDVMKKEVEEKKRGGDRGEDREDAGAGDKSNWMSTAQLWTGDSVRGDDASEKQDERRRSSEPESRDGAGLPSKAVGSGAPAFAPPSLRKDDKAVRMPDLPFLSPAPIKTSPAAATGGAEESRRQLVGFAQEAARAAAALAPAAPSLSLQAQSQQTAQQQQQQARKARRCWSPELHLQFVTALHQLGGPQVATPKQIRELMKVDGLTNDEVKSHLQKYRLHNRRAPGSPAANRPIVLMGGLWITQEQSSSQSGGSPPGPLNFSSSGVAASSVTVSGEEEDGRSESYGWK

SEQ ID NO: 261 - protein, 355 aa, Oryza sativa
  REGION 1..355: note = Public GI ID no. 125557053
  REGION 230..281: note = Pfam Name: Myb_DNA-binding Pfam Description: Myb-like DNA-binding domain
  REGION 1..355: note = Bit score of 433.4 for HMM based on sequences of Figure 3
  REGION 1..355: note = Functional Homolog Of SEQ ID NO. 246
  source 1..355: note = Oryza sativa subsp. indica
MGLDVGEIGVGAADLSLDLKMFAAKSFGRVRGKDTTTTAMGDCIRRLEEEMGKIEVFRRELPLCVRLLADVIDVMKEEVEKKGGDRKEDEEDAAGDKSNWMSTAQLWTGNSGGPDAAAADPEKQVKVRISSEAKSNGGAFVGSGAPAFARPKQSLMRKEDMAYDVRMPDLSLLSPPASAAAADESRRQVVGFSQAAARAAAMAASGPALSLQPQPQPAAAQQQQQARKTRRCWSPDLHRKFVAALQQLGGPQVATPKQIRELMKVDGLTNDEVKSHLQKYRLHNRPRVPSSTIVNQPIVLMQGLCYIPQEQSSSQSGSPEGPLHFSGSGMAGGGSSAATVSCEEEDGRSESYGWK

SEQ ID NO: 262 - protein, 274 aa, Oryza sativa
  REGION 1..274: note = Public GI ID no. 125588020
  REGION 152..203: note = Pfam Name: Myb_DNA-binding Pfam Description: Myb-like DNA-binding domain
  REGION 1..274: note = Bit score of 454.0 for HMM based on sequences of Figure 3
  REGION 1..274: note = Functional Homolog Of SEQ ID NO. 246
  source 1..274: note = Oryza sativa subsp. japonica
MKEEAGKRRKDGDDAEAKAEDGDKTKWMSTAQLWVDSRGSDADSENDRRSGSTSPASRLLGGAEESSSRAVAPPPYFRREERVVLRPAMPLLPPASHRSPPPAAAAAATAAGDDHRHVVASSFATAVPSPVPAALSLQAQAQQQQQQARKSRRCWSPELHRQFVAALQQLGGPQVATPKQIREVMKVDGLTNDEVKSHLQKYRLHNRKSPGTASASHSIVLVGDLWASQEVSCSQSGSPQGPLQLSGSGVAVSAATAGDSCCEDDDKSEGYVRK

SEQ ID NO: 263 - DNA, 1194 bp, Oryza sativa
  misc_feature 1..1194: note = Ceres Annot ID no. 1733246
  misc_feature 1..1194: note = Encodes the peptide sequence at SEQ ID NO. 264
  source 1..1194: mol_type = other DNA
atggggctggatgtgggggaaatcggcgtcggcgcggcggacctgagcctggatctcaagatgttcgccgccaagagcttcggccgcgtcaggggcaaggacaccaccaccaccgccatgggtgactgcatccggaggctcgaggaggagatgggcaagatcgaggtcttccgccgcgagctccccctctgcgtccgcctcctcgccgacgtgattgatgtgatgaaggaggaggtggagaagaagggtggtgatcgtaaggaggatgaggaggacgccgccggcgacaagagcaactggatgagcaccgcgcagctctggactgggaattccggcggcccagacgccgccgccgctgatccagaggacaaggtgaggatctcgtcggaggcgaagtccaacggcggcgcgtttgtgggctctggcgcgccggctttcgcgcggccgaagcagagcttgatgaggaaggaggacatggcgtacgacgtcaggatgccggatctgtcgctgctctcgccgcctgcttccgccgccgccgccgacgaaagccgccgtcaggtcgtgggcttctcccaggccgcggcgagggctgccgccatggcggcgtctggccccgctctcagcctccagccccagcctcagccggcggcggcgcagcagcagcagcaggcgaggaagacgaggcggtgctggtcgccggacctccaccgcaagttcgtcgccgccttgcagcaactcggtggccctcaagttgccactccaaagcaaatcagggagctgatgaaggtggatggactgacaaatgacgaggtcaaaagccatcttcaggtgaggaaaattcaccactgttttttttgtttaccacaagattttcttcatcaatgttcagtaacaatcatgacttctcgcgacggatttgcgatgatactgatgtcgatttttgcgattctgattgcgcagaagtaccgcctgcacaaccggccgagagtgccaagctcaacaattgtgaaccaaccgattgtgctcatgcaagggctctgttacattcctcaagagcaaagcagctcccagtctggatcccctgagggtcctctccatttctcaggctcaggcatggccggtggcggctcatcggcggcgacggtcagctgcgaggaggaggatggcaggtctgagagctatggctggaaatga

SEQ ID NO: 264 - protein, 397 aa, Oryza sativa
  REGION 1..397: note = Ceres Annot ID no. 1733246
  REGION 228..279: note = Pfam Name: Myb_DNA-binding Pfam Description: Myb-like DNA-binding domain
  REGION 1..397: note = Bit score of 376.0 for HMM based on sequences of Figure 3
  REGION 1..397: note = Functional Homolog Of SEQ ID NO. 246
MGLDVGEIGVGAADLSLDLKMFAAKSFGRVRGKDTTTTAMGDCIRRLEEEMGKIEVFRRELPLCVRLLADVIDVMKEEVEKKGGDRKEDEEDAAGDKSNWMSTAQLWTGNSGGPDAAAADPEDKVRISSEAKSNGGAFVGSGAPAFARPKQSLMRKEDMAYDVRMPDLSLLSPPASAAAADESRRQVVGFSQAAARAAAMAASGPALSLQPQPQPAAAQQQQQARKTRRCWSPDLHRKFVAALQQLGGPQVATPKQIRELMKVDGLTNDEVKSHLQVRKIHHCFFCLPQDFLHQCSVTIMTSRDGFAMILMSIFAILIAQKYRLHNRPRVPSSTIVNQPIVLMQGLCYIPQEQSSSQSGSPEGPLHFSGSGMAGGGSSAATVSCEEEDGRSESYGWK

SEQ ID NO: 265 - DNA, 1338 bp, Populus balsamifera
  misc_feature 1..1338: note = Ceres Annot ID no. 1451294
  misc_feature 1..1338: note = Encodes the peptide sequence at SEQ ID NO. 266
  source 1..1338: mol_type = other DNA
atggagcttagcttggatttgagtttggtttatgtaccgaaagcgataagtgaatgtcttaaagaggtttcaatggttaaagatggtagccaaaagttaccaaatcctgatgattatgtcaagagattagaagatgaaaggcgaaagatcgatgcttttaaacgtgaactccctctttgcatgcttctcttgaatgaagctattatcagattaaaggaagaggcaatgcagtgcaaagaattgaatgctttggtacccttgaagggggattctaatgaagatgggaatgataaaaaaaaatggatgagctctgttcagctctggaacactaacaataacatcaacttggattgcaaaaatcaagacacaagatcagaaccaaaacagagaggtgaagaagatgatgataggtctacttgtgagaacccaattcagttaggtaatcatggaaacaagggaggggcttttgtgcctttcaaggcactttctggttttgaaaggagtaaaaagaaggaagagaaggaggttgtttcacaagttacaggactttctcttatgaccccagtgcctaaatcctgcgattttatgtctaagagcaacaattgcggtaatcaaatgaagatacagagtaaatcacaacaacagcaacagcaacagcgacagcatgcttacaggaagcagcgaaggtgctggtcgccggagcttcaccggtgctttgttgatgcccttcaacaacttgggggatatcaagttgccactcctaaacagatcagagagcttatgcaagtagatggcctcaccaatgatgaagttaaaagccacttgcaaaaatacaggcttcatctccgcaaagtgccggcatcttcagctaccccagcaaatgacttgtggaaatctcaagatcaatgcgaggaccctgtaatgcataacatttcagagtctaattctccgaaagcacctcttcatggaagtagctctgccaaagctgcctctaattccggaggagatagcatggaagcagaagatgatgacaaatcagagagtcatagttggaatggcgtgcttcaccatccaggagaagttcatttaagttttaaaatctcaaatagcttattagctgaggggaaacaggaccaccatgcgcaggctctcgacttcgaggccacgggtgatattgttatcgtcggtagtgtaataagcctcgagaatccatgcactgttttagagctcgctgactcgtatggaattcaaaatattcctcttaaaaacaatacgcagcagcctgtgttgagaaaacagcagccatttgacaggaaaacagtaaacatgacagcctaa

SEQ ID NO: 266 - protein, 421 aa, Populus trichocarpa
  REGION 1..421: note = Ceres Annot ID no. 1451294
  REGION 204..255: note = Pfam Name: Myb_DNA-binding Pfam Description: Myb-like DNA-binding domain
  REGION 1..421: note = Bit score of 379.6 for HMM based on sequences of Figure 3
  REGION 1..421: note = Functional Homolog Of SEQ ID NO. 246
MVKDGSQKLPNPDDYVKRLEDERRKIDAFKRELPLCMLLLNEAIIRLKEEAMQCKELNALVPLKGDSNEDGNDKKKWMSSVQLWNTNNNINLDCKNQDTRSEPKQRGEEDDDRSTCENPIQLGNHGNKGGAFVPFKALSGFERSKKKEEKEVVSQVTGLSLMTPVPKSCDFMSKSNNCGNQMKIQSKSQQQQQQQRQHAYRKQRRCWSPELHRCFVDALQQLGGYQVATPKQIRELMQVDGLTNDEVKSHLQKYRLHLRKVPASSATPANDLWKSQDQCEDPVMHNISESNSPKAPLHGSSSAKAASNSGGDSMEAEDDDKSESHSWNGVLHHPGEVHLSFKISNSLLAEGKQDHHAQALDFEATGDIVIVGSVISLENPCTVLELADSYGIQNIPLKNNTQQPVLRKQQPFDRKTVNMTA

SEQ ID NO: 267 - DNA, 1317 bp, Populus balsamifera
  misc_feature 1..1317: note = Ceres Annot ID no. 1457031
  misc_feature 1..1317: note = Encodes the peptide sequence at SEQ ID NO. 268
  source 1..1317: mol_type = other DNA
atggagcttagcttggacttgagtttggtttgtgaaccaaaaacaataaatgaatgtcttaaagaggtttcgatggttaaagatggaagccaaaagttaacaaagctttatgattatgtcgagagattagaagatgaacggagaaagattgatgcttttaaacgtgaactccctctttgcatgcttctcttgaatgaagctattgcgagattaaaggaggaggcaatgcagtgcagtgaattgaacgatttgataccattgaaagggaattccaatgaagatgggaatgataaaaagaactggatgagttctgttcagctttggaacactaacaaccacttggattgcaaaaagcaagactcgaaatcagaaccaaaacagaaaagtgaagaagatgatgataggtctacttgtgagaacccagttcagttaggtgatcatagcaacaagggagaggcttttgtgcctttcaaggctctttctggttttgaagggagtaaaaggaaggaagaaaaggaggttgtttcgcaagttaccggactttctcctatgactccagttcctgatttgagttcctgcaattggacgcgaaagagcaacaattgtagtaatcaaacgaagatactgagtaaatcacaacagcaggcttacaggaagcagcggcggtgctggtcaccagagcttcaccggcgctttgttgatgcccttcaacaacttggtggttgtcaagtggccactcctaaacagatcagagagcatatgcaagtggatggcctcaccaatgatgaagttaaaagccacttgcaaaaatacaggcttcatctccgtaaagtcccagcatccccagcagccccagcatctcaagatcaatgcaaggacccttcaacaggtaacatttcacagtctaattctccgaaaggatccctccatgcaagtggctctgccaaggctacctctaatactggaggagatagcatggaagcagaagacgatgacaaatcagagagtcatagttggaatggtgcgcttcacaaaccaggagaagctcattttcattcacacttgaaacatatagctattatatttttttcaatctcaaatagcttgttagttgatgggaaacaagaccaccgtgcgcaggccctcggacttcgaatccatggggatattggcatcaatatcatcagtagggtgtgtaaagaagcatcctatcagagatctctgccttcccctttctctagtcatatggcatccaggacatttagcagaatccgatgtcgagaaacacagcaacaatttgacaggaaaaaacagtaa

SEQ ID NO: 268 - protein, 414 aa, Populus trichocarpa
  REGION 1..414: note = Ceres Annot ID no. 1457031
  REGION 197..248: note = Pfam Name: Myb_DNA-binding Pfam Description: Myb-like DNA-binding domain
  REGION 1..414: note = Bit score of 377.6 for HMM based on sequences of Figure 3
  REGION 1..414: note = Functional Homolog Of SEQ ID NO. 246
MVKDGSQKLTKLYDYVERLEDERRKIDAFKRELPLCMLLLNEAIARLKEEAMQCSELNDLIPLKGNSNEDGNDKKNWMSSVQLWNTNNHLDCKKQDSKSEPKQKSEEDDDRSTCENPVQLGDHSNKGEAFVPFKALSGFEGSKRKEEKEVVSQVTGLSPMTPVPDLSSCNWTRKSNNCSNQTKILSKSQQQAYRKQRRCWSPELHRRFVDALQQLGGCQVATPKQIREHMQVDGLTNDEVKSHLQKYRLHLRKVPASPAAPASQDQCKDPSTGNISQSNSPKGSLHASGSAKATSNTGGDSMEAEDDDKSESHSWNGALHKPGEAHFHSHLKHIAIIFFSISNSLLVDGKQDHRAQALGLRIHGDIGINIISRVCKEASYQRSLPSPFSSHMASRTFSRIRCRETQQQFDRKKQ

SEQ ID NO: 269 - DNA, 1300 bp, Gossypium hirsutum
  misc_feature 1..1300: note = Ceres Clone ID no. 100063507
  misc_feature 1..1300: note = Encodes the peptide sequence at SEQ ID NO. 270
  source 1..1300: mol_type = other DNA
gagaaacataatggaatttagcttggatttgagttcggtttttgttccaaaaaccataaccgagtttctcaaagaagcttcgaaaatcaaagatgggttccaaagatcatcaaagattagtgattatgttaaaagattggaagatgagatgaagaaaattgatggctttaaacgtgaacttcctctttgcatgcttctcttgaaagatgggattgagagattgaaggtggaagaaatgcagtgtaaagaaacggacgacggattgccattgaaggaaaatgatgacggtgacaagacaaactggttgagttcagtacaactgtggaactctgatttcaacatcgttgatcataacaagaaaccgaacacagtttcagagctgaaactgagaagtggcagagaagaagaagaagaagatatgtctgaaaacccaattaaagtttgtaacaataaaagcaggggaggggcttttgttccatttaaggatatttcaggaattcgtcttatgaacccaagttttgaattagtatcttgtaatggaatcttgagaaacaatggcggctgcacaattggttccggttcttccttaaccgcagaaaaaacccaaattaagtttcagacagaatcacaagatcaacaaaaactgcagcagaattcgaggaaacagaggcgatgctggtcacctgagcttcatagactatttgttgatgcccttcagcagcttggaggttctcaagtggcaactcctaaacagattaaagaagtgatgcaagttgatgatctcaccaatgatgaagtgaaaagccatttgcagaaatatagactccacatccgaaaacttccgccttcttcaactcgaaaccagtgcagtgagaacatgaaatcacagtctggttctccacaatgtcccctcaccgtgagtgctttggctaaaggaatgtcgagtaccggcggtgacagtatggacggcgaagaggacgaaaaatcagatggccttagttggagaagtggagttcacaagccaggagagattgaatgtatagtaagataacttattcccatcaatttttacaaaaaaaaaacatggggaaaattgaagataattctagtgagttagtgagaataatttagtcaacaagtagagcaattcgaaatcgatatcctgttttaggcactacagagggcgattattcaaagagatttttgcagatatcatggactggtttagtttatgctctaatatggaatcagtttgtgctattctattgatggataatagggagagaatgacaagttcctt

SEQ ID NO: 270 - protein, 346 aa, Gossypium hirsutum
  REGION 1..346: note = Ceres Clone ID no. 100063507
  REGION 220..271: note = Pfam Name: Myb_DNA-binding Pfam Description: Myb-like DNA-binding domain
  REGION 1..346: note = Bit score of 380.6 for HMM based on sequences of Figure 3
  REGION 1..346: note = Functional Homolog Of SEQ ID NO. 246
MEFSLDLSSVFVPKTITEFLKEASKIKDGFQRSSKISDYVKRLEDEMKKIDGFKRELPLCMLLLKDGIERLKVEEMQCKETDDGLPLKENDDGDKTNWLSSVQLWNSDFNIVDHNKKPNTVSELKLRSGREEEEEDMSENPIKVCNNKSRGGAFVPFKDISGIRLMNPSFELVSCNGILRNNGGCTIGSGSSLTAEKTQIKFQTESQDQQKLQQNSRKQRRCWSPELHRLFVDALQQLGGSQVATPKQIKEVMQVDDLTNDEVKSHLQKYRLHIRKLPPSSTRNQCSENMKSQSGSPQCPLTVSALAKGMSSTGGDSMDGEEDEKSDGLSWRSGVHKPGEIECIVR

SEQ ID NO: 271 - DNA, 1368 bp, Glycine max
  misc_feature 1..1368: note = Ceres Clone ID no. 560820
  misc_feature 1..1368: note = Encodes the peptide sequence at SEQ ID NO. 272
  source 1..1368: mol_type = other DNA
ctctttcgttatctggtcatggttgtttgcgacttctgggagctcagtctcgctcagagtcagagaaaaacacccaaatcaaatattatcatggagcccagcttggatttgagactgggctttgtccccaaacccctttccctgtttttcggcgacgtttctgggaacagagacaagtgcgacaaagtggtcacactcgatggcttcgtgcagagattggaggaagagttgacaaaggtcgaggctttcaaacgcgagcttcctctctgcattctcctcctaaacgatgctatagcgagattgaaggaggaaaaagtgaagtgttcgggaatgcaagatccgcctcttaaaaccagttcaggaggaaatgaaaatgaaaactctgagaagaagaattggatgagttcagcacagctttggagcactcagaaatccaaatcgaggaatgaggaagatgataggtctgtgccagcgaactcaattaatgggaattcgtgtgtccccgagaaggagggctcgcaagttccgagctttggtttgatggctcgtgcttctgaactgagtcatagcaattccaagagtgttggtggagatactagttctggctcctctttgctccgtgttgaggtacagagtcagccacagccgccgcagcatatgcagcagaatccgaggaaacaacggcggtgctggtcgccggagcttcaccggcgctttgtggacgcccttcaacaacttggtggagcacaagtggccactcctaaacagattagagaactgatgcaggtggaaggccttacaaatgatgaagtgaaaagtcatttgcaaaagtacaggcttcatgttaggagattcccagttttttcaattggccaggttgataatggctcatggatgacacaggatgaatgtggggataaatcaaagggaaacatgtcacagtctggttctccacagggtcctctcacacctctgctcctaggaggagcaggatccgctaagggtctctcaagccctggacggaacagtgtggatgcagaagatgagcaatcatcagattgccggaattggaaaggagggctccaccaccagcagcttgaaactgataatcacagcctctaaaattttgcagataaatgataatacaatacataaaatgatgaggagttgaaggcccagaatttgacaacataagaataatagagatctaacacataaaagaactatagggatcaagtttatgctaccagtattttaaactgtttggtagagagcaactgaggttttgcagatttttcaaggtttcttcttttctatttttaaactcagtatagttgtatggagcttaaattttactgggcaattttc

SEQ ID NO: 272 - protein, 343 aa, Glycine max
  REGION 1..343: note = Ceres Clone ID no. 560820
  REGION 198..249: note = Pfam Name: Myb_DNA-binding Pfam Description: Myb-like DNA-binding domain
  REGION 1..343: note = Bit score of 329.7 for HMM based on sequences of Figure 3
  REGION 1..343: note = Functional Homolog Of SEQ ID NO. 246
MEPSLDLRLGFVPKPLSLFFGDVSGNRDKCDKVVTLDGFVQRLEEELTKVEAFKRELPLCILLLNDAIARLKEEKVKCSGMQDPPLKTSSGGNENENSEKKNWMSSAQLWSTQKSKSRNEEDDRSVPANSINGNSCVPEKEGSQVPSFGLMARASELSHSNSKSVGGDTSSGSSLLRVEVQSQPQPPQHMQQNPRKQRRCWSPELHRRFVDALQQLGGAQVATPKQIRELMQVEGLTNDEVKSHLQKYRLHVRRFPVFSIGQVDNGSWMTQDECGDKSKGNMSQSGSPQGPLTPLLLGGAGSAKGLSSPGRNSVDAEDEQSSDCRNWKGGLHHQQLETDNHSL

SEQ ID NO: 273 - DNA, 1365 bp, Glycine max
  misc_feature 1..1365: note = Ceres Clone ID no. 1104471
  misc_feature 1..1365: note = Encodes the peptide sequence at SEQ ID NO. 274
  source 1..1365: mol_type = other DNA
atctgggcatgatagtttgcgacttctgggaccatagtctcgctctgagttagagaaaaacaccaaaaccacaaatactaccatcatggagctgagtttggatttgagtttaggctttgttcccaaacctctttccctgtttttcgccgacgtttctgcgaacagagacaaagtggccacactcgatggcttcgtgcagagattggaggaagaattgaaaaaggtcgaggctttcaaacgtgagcttcctctctgcattcttctcctaaacgatgctatagctagattgaaggaggaaaaagtgaagtgttcgggaatgcaagatccgccactgaaaaccagttctggaggaaacaaaaatgaaagctctgagaagatgaattggatgagttcagcgcagctttggagcactcagaaaaccaaatcgagaaatgaggaagatgataggtctgtgccagcgaacccaattaatgggaattcgtgtgtcctcgagaaggagggttcccaagttccgagctttggtttgatggctcgtgcttctgaactgagtcatagcaattccaagagtgttggtggagatattagttctggctcctctttgctccgtgttgaggtacagagtcagccacaaccgccgcaacatatgcaacagaatccgaggaaacaacgccgctgctggtcgccggagcttcaccgccgctttgtggacgctcttcaacaacttggtggagcacaagtggccactcctaaacagattagagaactgatgcaggtggaaggccttacaaatgatgaagtgaaaagccatttgcaaaagtacaggcttcacgttaggagatttccagtttcttcaactggccaggctgataatgggtcatggatgtcacaagatgaatctggggataaatcaaagggaaacaacatgtcacagtctggttctccacaaggtcctctcacacctctgatcctaggaggaggaggaggaggatctgctaagggtctctcaagccctggacagaacagtgtggatggagaagatgagcaatctgattgccggaattggaaaggagggctccaccaccaccagcttgaagctgataatcaatgcctctaatattttgcagataaattataatacaatacataaatgatgaagagttgaagacccagaatttgacaacataagaataatagatctaacacatagaagaactatagggatcaagttttatgctaccattattttaaactgtttggtagagagcaactgaggttttacaaatttttcgggtttcttcttttttaaactcggtatagttgtatggagcttaacttttactgggcaattttcatagattaatcccc

SEQ ID NO: 274 - protein, 342 aa, Glycine max
  REGION 1..342: note = Ceres Clone ID no. 1104471
  REGION 195..246: note = Pfam Name: Myb_DNA-binding Pfam Description: Myb-like DNA-binding domain
  REGION 1..342: note = Bit score of 337.4 for HMM based on sequences of Figure 3
  REGION 1..342: note = Functional Homolog Of SEQ ID NO. 246
MELSLDLSLGFVPKPLSLFFADVSANRDKVATLDGFVQRLEEELKKVEAFKRELPLCILLLNDAIARLKEEKVKCSGMQDPPLKTSSGGNKNESSEKMNWMSSAQLWSTQKTKSRNEEDDRSVPANPINGNSCVLEKEGSQVPSFGLMARASELSHSNSKSVGGDISSGSSLLRVEVQSQPQPPQHMQQNPRKQRRCWSPELHRRFVDALQQLGGAQVATPKQIRELMQVEGLTNDEVKSHLQKYRLHVRRFPVSSTGQADNGSWMSQDESGDKSKGNNMSQSGSPQGPLTPLILGGGGGGSAKGLSSPGQNSVDGEDEQSDCRNWKGGLHHHQLEADNQCL

SEQ ID NO: 275 - protein, 363 aa, Arabidopsis thaliana
  REGION 1..363: note = Public GI ID no. 30690890
  REGION 219..270: note = Pfam Name: Myb_DNA-binding Pfam Description: Myb-like DNA-binding domain
  REGION 1..363: note = Bit score of 793.5 for HMM based on sequences of Figure 3
  REGION 1..363: note = Functional Homolog Of SEQ ID NO. 246
MVQTETDQRMGLNLNLSIYSLPKPLSQFLDEVSRIKDNHSKLSEIDGYVGKLEEERNKIDVFKRELPLCMLLLNEEIVFLCVAIGALKDEARKGLSLMASNGKFDDVERAKPETDKKSWMSSAQLWISNPNSQFRSTNEEEEDRCVSQNPFQTCNYPNQGGVFMPFNRPPPPPPPAPLSLMTPTSEMMMDYSRIEQSHHHHQFNKPSSQSHHIQKKEQRRRWSQELHRKFVDALHRLGGPQVATPKQIRDLMKVDGLTNDEVKSHLQKYRMHIRKHPLHPTKTLSSSDQPGVLERESQSLISLSRSDSPQSPLVARGLFSSNVGHSSEEDEEEEDEEEEKSDGRSSCRNDETKKKRQVLDLEL

SEQ ID NO: 276 - protein, 333 aa, Arabidopsis thaliana
  REGION 1..333: note = Public GI ID no. 18402692
  REGION 194..245: note = Pfam Name: Myb_DNA-binding Pfam Description: Myb-like DNA-binding domain
  REGION 1..333: note = Bit score of 205.2 for HMM based on sequences of Figure 3
  REGION 1..333: note = Functional Homolog Of SEQ ID NO. 246
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 277 - DNA, 1373 bp, Arabidopsis thaliana
  misc_feature 1..1373: note = Ceres Clone ID no. 2686
  misc_feature 1..1373: note = Encodes the peptide sequence at SEQ ID NO. 278
  source 1..1373: mol_type = other DNA
gtttcttcttcacactctgattctcttactattttactctgttgttgttgttgtgatatcaagagagtgggtttgagatcatgccaaattctggaaaaagtttgagtttttaattccaatcgagaaaaaataaaaatgggttctttaggtgatgagcttagtttgggatcgatctttgggagaggagtttcgatgaatgttgtggcggtggagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagacgcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcagagattatacttagccttgtttttgtaaacggctttttttggttgggtttttatttttcttgaggcattatccaatattcaagtg

SEQ ID NO: 278 - protein, 333 aa, Arabidopsis thaliana
  REGION 1..333: note = Ceres Clone ID no. 2686
  REGION 194..245: note = Pfam Name: Myb_DNA-binding Pfam Description: Myb-like DNA-binding domain
  REGION 1..333: note = Bit score of 199.7 for HMM based on sequences of Figure 3
  REGION 1..333: note = Functional Homolog Of SEQ ID NO. 246
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRRNAQSDSPQGPLQLPSTTTTTGGDSSMEDVEDAKSESFQLERLRSP

SEQ ID NO: 279 - DNA, 2109 bp, Panicum virgatum
  misc_feature 1..2109: note = Ceres Clone ID no. 1900192
  misc_feature 1..2109: note = Encodes the peptide sequence at SEQ ID NO. 280
  source 1..2109: mol_type = other DNA
ataaccgcatagcgcacgaccccggccgggccgagcgagccagagcccagagccagagcgaagagggagagagagagagagagagacagcgagcatatatgagacgtctacggtagctgtgctcatggtgatggggaggccgaaccagagccacgggagcgggggcgacgaggagcggctgcccctgcgcggcgggctggagacggagcgggcgccgccgccgccccaccacgccgcggagcagctcaaggaggcgaggcgcgggggcggcaggctctggcgcgcgtccgtgcgcgccggcctggtgctctgcctgctgacggttccggccgtcctgctcttgctgcggtggcaggccgactcctcgccgcagtgggtctttgacttcgaggcgcccgaggaagacgacgacgaccaagatatacaagatgatgtgtctgacgatatatctccgtccccacaaattgagtatgatagacttctgggtggccttctgatcgagggatttgatgaaaaatcttgtaggagcaggtatcagtttgcacgctatcacaagtcaccaagcataccttcaccgtacctcatagagaggttaaggaaacaagaattgttgcagaaaaagtgtggtccaggcaccaaagcatataaggaagcatcaaagcagctgaggtccggtcagagtcagaccaccaataccacagattgcaactatctgatactgaccatccacgctggcttggggaatcggatgcttgagattacttcagcattactatatgcgctacttacaaatcggattttgcttgtggaccgctacaaggagattggtgaccttttctgcgaacccttccctggaacctcatggttagtcccttcagatttccctctgagctatggcgagtttactcagagtagtccagagagctatggcaacatgctgcagaacaaagctgccggtggcaatacaaatcgatctttggctggtactcggcctaactatgtgtatctccacctcgatggtaactatggtttccatgacaaacttttcttctgcgaagacgaccagcagttcctgcaaggtgttccatggctgatcataagaacagacatgtactttgtgccgtccctgtttctaattccaggtttccaagatgaactcagcaggctatttccagagaaagacactgttttccatcacttggcacgctatctttttcatccaacaaacaatatttggtattctattacaaaatactaccggtcctacatggccaaagcggaaaaaagagtgggaattcagataagaatatatgaaaccaagggcatcttgcaaagaaatggcccattcccgcacattttgaatcagatcctttcatgtgcacagaatgagaagctcctgccagaaattggcatgatggagggagcagcagctgaagctcagaataagggagcagcagctgagactcaaaataaccaaacaatcgtcgttctaactacttctttgagctcttggtacagtgatcagatccagaagaaatacgaagaacacccaacagttgatggaactactgtcaaagtgtaccagccaagccacgaggagtaccagaggtcaaggaataggaagcacaacatgaaggcacttgccgagatctatctactgagcatgaacgatgagctaatcaccagtggcttttccacattcgggtacgcagctcaggggctcgctggcctgaagccatggatcatgttcaggtcagagaaccacgtgacaccagatccaccgtgcggccgcgtcatgtccattgagccgtgcttccaccaggctcccttctacgactgcaaggcaaagagggacactgacttgggcaaggtggtgccttacgtgaggcactgcgaggacgtgagctggggtctgaagattgtaaatgaaactaagttgtagctgtagttttgtcaggactcaaggcagattttctcgctaactagggcagaagtatttttttttgtttcaaaagaaactatacgttgtattctttccctctcctgtatttgatccaactgtagataagttgatgaacaggtccattaatctgttcgctctctgattcc

SEQ ID NO: 280 - protein, 605 aa, Panicum virgatum
  REGION 1..605: note = Ceres Clone ID no. 1900192
  REGION 1..605: note = Ceres Seed Line no. UAC-20
  REGION 72..574: note = Pfam Name: XG_FTase Pfam Description: Xyloglucan fucosyltransferase
  REGION 1..605: note = Bit score of 1496.9 for HMM based on sequences of Figure 10
  REGION 1..605: note = Figure 10
MVMGRPNQSHGSGGDEERLPLRGGLETERAPPPPHHAAEQLKEARRGGGRLWRASVRAGLVLCLLTVPAVLLLLRWQADSSPQWVFDFEAPEEDDDDQDIQDDVSDDISPSPQIEYDRLLGGLLIEGFDEKSCRSRYQFARYHKSPSIPSPYLIERLRKQELLQKKCGPGTKAYKEASKQLRSGQSQTTNTTDCNYLILTIHAGLGNRMLEITSALLYALLTNRILLVDRYKEIGDLFCEPFPGTSWLVPSDFPLSYGEFTQSSPESYGNMLQNKAAGGNTNRSLAGTRPNYVYLHLDGNYGFHDKLFFCEDDQQFLQGVPWLIIRTDMYFVPSLFLIPGFQDELSRLFPEKDTVFHHLARYLFHPTNNIWYSITKYYRSYMAKAEKRVGIQIRIYETKGILQRNGPFPHILNQILSCAQNEKLLPEIGMMEGAAAEAQNKGAAAETQNNQTIVVLTTSLSSWYSDQIQKKYEEHPTVDGTTVKVYQPSHEEYQRSRNRKHNMKALAEIYLLSMNDELITSGFSTFGYAAQGLAGLKPWIMFRSENHVTPDPPCGRVMSIEPCFHQAPFYDCKAKRDTDLGKVVPYVRHCEDVSWGLKIVNETKL

SEQ ID NO: 281 - DNA, 1815 bp, Sorghum bicolor
  misc_feature 1..1815: note = Ceres Annot ID no. 8681689
  misc_feature 1..1815: note = Encodes the peptide sequence at SEQ ID NO. 282
  source 1..1815: mol_type = other DNA
atggggaggcaaagcaatagctacgggagcgggggcgacgaggagcggctgcccctccgcggcgtgctggagacgcagcagcgggcgccggggacgccgccgccggtccaccacgccgcggagcagctgaaggaggcgaggcgcgggggcagcaggctctggcgcgcgtccgtgcgcgccgggctggtgctctgcctgctgaccgtcccggccgtcctgctgctgctgcggtggcaggccgacgcctcgccgcagtgggtcttcgacttcgaggcccccgaggaagacgacgaccaagatatacaagatgatatgtccgatgatctatctccatcgccacaaatagcgtacgaccgacttctgggtggccttctggttgagggttttgatgagaaatcatgtagaagcaggtatcagtttgcacgctatcacaattcaccaagcataccttctgcatacctcatagagaggttaaggaaacaagaagctttgcagaaaaagtgtggtccaggcaccaaagcatacaaggaagcctcaaagcagctgaagtatggtcaaagcatcaatacgacagattgcaactatctgtatctgattatccatgctggcttagggaaccggatgcttgagatcacttcagcattcctttatgcgctacttacaaaccggattttgctcgtggaccgttataaggagattgcagaccttttttgtgaaccctttcctggaacatcgtggttggttccttcagatttccctctgaacaatgacgagttcagtcagactagtcctgagagctatggcaacatgctccagaataaagttttcggtggaaatacagatcgatctttggctggtaatagacctccctatgtgtatctccaccttgatggcacctatggtttccatgacaaacttttcttctgtgaagacgaccaacagttcctgcaagaggtttcatggttgatcatgagaacagacatgtactttgtgccgtccctatttctcattccagctttccaagatgaactcagcaggctatttcctgagaaagacactgttttccatcacttggcacgctatctttttcatccgacaaataatgtttggtattcagttacaaaatacttccggtcctacctggccaaagctgaaaaaagagtgggaattcagatcagaatatatgaaaccaaaggtatcttacaaagaaatggtccgttcccacacattttgaatcagatcctctcatgtgctcaaaatgaaaagctgcttccagaagttagtatggcagagggagcagcagctgagactcagaataaccgaacagcagctgggactcagaataaccgaacgattgctgttctaacaacttctttgagctcttggtacagtgatcagattcagaagaagtacgatgagcaaccagctgttgatggcataactgtcaaagtgttccagccgagccacgaggagtaccagaggtcaaggaacaagaagcacaacatgaaggcacttgctgagatctatctactgagcatgagcgatgaactgataaccagtggcttttccacgtttgggtacgctgctcaggggctcgctggcctgaagccatggatcatgtttaagtcggagaaccacgtgatgccagacccaccgtgcggccgtgccatgtccattgagccgtgcttccatcaggctcccttctacgactgcaaagcgaagaaggacgctgatttgggcaaggtagtgccttatgtgaggcactgcgaggacgtgagctgggggctgaagattgtaaatcaaactcatttgtag

SEQ ID NO: 282 - protein, 604 aa, Sorghum bicolor
  REGION 1..604: note = Ceres Annot ID no. 8681689
  REGION 86..573: note = Pfam Name: XG_FTase Pfam Description: Xyloglucan fucosyltransferase
  REGION 1..604: note = Bit score of 1514.3 for HMM based on sequences of Figure 10
  REGION 1..604: note = Functional Homolog Of SEQ ID NO. 280
  REGION 1..604: note = Figure 10
MGRQSNSYGSGGDEERLPLRGVLETQQRAPGTPPPVHHAAEQLKEARRGGSRLWRASVRAGLVLCLLTVPAVLLLLRWQADASPQWVFDFEAPEEDDDQDIQDDMSDDLSPSPQIAYDRLLGGLLVEGFDEKSCRSRYQFARYHNSPSIPSAYLIERLRKQEALQKKCGPGTKAYKEASKQLKYGQSINTTDCNYLYLIIHAGLGNRMLEITSAFLYALLTNRILLVDRYKEIADLFCEPFPGTSWLVPSDFPLNNDEFSQTSPESYGNMLQNKVFGGNTDRSLAGNRPPYVYLHLDGTYGFHDKLFFCEDDQQFLQEVSWLIMRTDMYFVPSLFLIPAFQDELSRLFPEKDTVFHHLARYLFHPTNNVWYSVTKYFRSYLAKAEKRVGIQIRIYETKGILQRNGPFPHILNQILSCAQNEKLLPEVSMAEGAAAETQNNRTAAGTQNNRTIAVLTTSLSSWYSDQIQKKYDEQPAVDGITVKVFQPSHEEYQRSRNKKHNMKALAEIYLLSMSDELITSGFSTFGYAAQGLAGLKPWIMFKSENHVMPDPPCGRAMSIEPCFHQAPFYDCKAKKDADLGKVVPYVRHCEDVSWGLKIVNQTHL

SEQ ID NO: 283 - protein, 604 aa, Zea mays
  REGION 1..604: note = Public GI ID no. 226529851
  REGION 69..573: note = Pfam Name: XG_FTase Pfam Description: Xyloglucan fucosyltransferase
  REGION 1..604: note = Bit score of 1475.7 for HMM based on sequences of Figure 10
  REGION 1..604: note = Functional Homolog Of SEQ ID NO. 280
  REGION 1..604: note = Figure 10
MGRPSNSHGGGGDEERLPLRGVLETSPSHHAAVQAKDKEARRGGSRLWRASVRAGLLLCLLTVPAVLLLLWWQADSSPQWVFDFEPPEEDDDQDIQDDMSDDLSPSPQIEYDRLLGGLLVEGFDDKSCRSRYRFARYHSSPSIPSPYLIERLRKQEALQKKCGPGTRAYREASKQLKSGQSMSINATDDCNYLFLIIHAGLGNRMLEITSAFLYALLTNRILLLDRYKEIADLFCEPFPGTSWLVPSDFPLNDDEFGQSSAESYGNMLQNKAFGGGTDRSLVGNRLPPYVYLHLDGNYGFHDKLFFCEDDQQFLRGVPWLVMRTDMYFVPSLFLVPAFQDELGRLFPEKDTVFHHLARYLFHPTNGVWYSVTRCFRSYLAKAEKRVGIQIRIYETKGILQRNGPFPHILNQILSCAQNEKLLPEISMAEGAADGTRNNRTAAGSGTRNNRTIAVLTTSLSAWYSEQIQEKYDEQSAVDGVSVRVFQPSHEEYQRSRNKGHNMKALAEIYLLSMTDVLITSGFSTFGYAAQGLAGLKPWIMLKSENHVTPDPPCVRAMSIEPCFHQAPFYDCKARKDTDLGKVVPYVRHCEDVSWGLKIVDQTHL

SEQ ID NO: 284 - protein, 533 aa, Oryza sativa
  REGION 1..533: note = Public GI ID no. 115448865
  REGION 9..502: note = Pfam Name: XG_FTase Pfam Description: Xyloglucan fucosyltransferase
  REGION 1..533: note = Bit score of 1337.4 for HMM based on sequences of Figure 10
  REGION 1..533: note = Functional Homolog Of SEQ ID NO. 280
  REGION 1..533: note = Figure 10
  source 1..533: note = Oryza sativa subsp. japonica
MIPVVVVLHRCAVSSSWPDRVFEAKHIAGAGEQDMQDDLPDDLTASQYIGYDKFLGGLLQEGFDEVSCRSRYQFARYHKNFTRIPSSYLLERLRRQEALQKKCGPGTKSYKQAVKLLRSSQGVNMTTDCNYLFLTVHAGLGNRMLEIASAFLYALLTNRILLLDRYQEIGDLFCEPFPGTSWLMPSDFPLNYGEFTQSSPESYGNMLQNKVVGDNTDQSLAGSRPPYVFLYLDGNYEFHDKLFFCEDDQQFLQDVPWLIMRTDMYFIPSLFLIPSYQDELSRLFPEKDAVFHHLARYLFHPTNSIWYSVKGYYRSYLAKANKTVGIQIRIFEKEGILQKNGRFPYVLEQILSCAQNEKLLPEISMKDEAEAPTAPKNNQTIAVLTTSLSSWYSDQIQKKYSEHPTVDGTRVEVYQPSHEEYQRSKNKKHNMKALAEIYLLSMTDVLITSGFSTFGYAAQGLSGLTPWIMFRSENHAMPDPPCRRAMSIEPCFHQAPFYDCKAKRNADLGKMVPFVRHCEDVSWGLKVVNQTQW

SEQ ID NO: 285 - protein, 578 aa, Populus X canescens
  REGION 1..578: note = Public GI ID no. 154163107
  REGION 69..546: note = Pfam Name: XG_FTase Pfam Description: Xyloglucan fucosyltransferase
  REGION 1..578: note = Bit score of 1466.2 for HMM based on sequences of Figure 10
  REGION 1..578: note = Functional Homolog Of SEQ ID NO. 280
  REGION 1..578: note = Figure 10
MDLKSSTRRRSPPSEDTDQQLAQNSKMQAKRFGSNGITFTQIFAYCLVALPIIFAISLIFRHPSSDRTMGFADARVLENRGVKQNATPIGAGGSEGVLFQLADKYNGKLLGGLLADGFDEAACTSRYSSFLYRKISLHKPSSYLISRLRSYEDLHKRCGPNTQSYNKALEQLKSGNKIGLTDCNYIVWISFSGLGNRILSLASTFLYALLTNRVLLVDQGKDMADLFCDPFPDKSWLLPRDFPLIDQFDSFNQNSPHCHGNMLKNNAINSSAMSKPSYLYLHLVHDYGDHDKLFFCDGEQSFLENVPWLIMKTDNYYVPSLFLIPSFETELSNLFPEKGTVFHHLGRYLFHPSNHVWGLITRYYRTYLAKADERIGIQIRTFDSRRGPFKHVMDQILACTLKEKLLPAVDMQDSVVNPSENAKLKAVLVTSLLSGYSEDLRNMYWEHPTMTGEVVGVYQPSHEEFQQTEKQMHNRKAWAEMYLLSLTDVLVTSAWSTFGYVAQGLGGLRPWILYKTENDTAPDPPCRRAMSTEPCFHAPPFYDCKAKKGIDTGTLVPHVRHCEDISWGLKVVDDHDDL

SEQ ID NO: 286 - protein, 661 aa, Vitis vinifera
  REGION 1..661: note = Public GI ID no. 147817757
  REGION 156..626: note = Pfam Name: XG_FTase Pfam Description: Xyloglucan fucosyltransferase
  REGION 1..661: note = Bit score of 1487.2 for HMM based on sequences of Figure 10
  REGION 1..661: note = Functional Homolog Of SEQ ID NO. 280
  REGION 1..661: note = Figure 10
  VARIANT 71: note = X can be any amino acid
  VARIANT 119: note = X can be any amino acid
  VARIANT 124: note = X can be any amino acid
  VARIANT 377: note = X can be any amino acid
  VARIANT 384: note = X can be any amino acid
  VARIANT 388: note = X can be any amino acid
  VARIANT 454: note = X can be any amino acid
  VARIANT 502: note = X can be any amino acid
  VARIANT 656: note = X can be any amino acid
MKSITLVATESGSGAKKGPRRRAGYGMEPNPRGPFLTQNRQVQILPARSFESFHRQRTLTSEYPFLTHPFXASWSRTASAQQPBVDSTHVMRLRRNTDDEQLRLSDPEHHTVSRPLDRXCEQNXMRLMGILVVCLMVVSVLFSVSVVLRDPPSDGVWASEETKFLQVNPRKDAEDNLSWSAEEPKDKLLGGLLDAGFNERSCLSRYQSALYRKELLHKPSSYLLSKLRSYEALHKRCGPYTESYNRTLKQLQLGQHMEQSDCNYLVWISFSGLGNRILTLASAFLYAILTNRVLLVDPGADMPDLFCEPFPEVSWLLPLDFPLKNZFNSFDQKSPFCYGKMLKNKTLTDSSWSILPPYVYLHLVHDYDDHDKMFFCXQDQSFLXKIPXLIIKTDNYFVPSLFLIPSFEQELSNLFPVKGTVFHFLGRYLFHPTNVVWGLITRYYQAYLAKADEXIGIQIRVFDTGIGPFQHVLDQIIACTMTENLLPEINMREPVVSSYGHXKSKAVLMTSLSAGYFEKVRNMYWEHPTVTGEVIGVYQPSHEEYQQTEKQNHNRKAWAEMYLLSLTDVLVTSSWSTFGYVAQGLGGLKPWILYKPENQTAPDPPCRRAMSMEPCFHAPPFYDCKAKKGVDTGALVPHVRHCEDMSWGLKLVDBSXEHGAL

SEQ ID NO: 287 - DNA, 1923 bp, Gossypium hirsutum
  misc_feature 1..1923: note = Ceres Clone ID no. 1925709
  misc_feature 1..1923: note = Encodes the peptide sequence at SEQ ID NO. 288
  source 1..1923: mol_type = other DNA
attcctataccctcctatcgcacctgatcctaaaccctgcccaactcccctcttcaactttgctgctccccactcttcttctgctttctattactttgggctgataatatgaagcggttaaggagaaacccggatgagagtgacccggaaaccaccccggatcctgacggagaagtctctttttcgaaagatcaacacgaaaggaaatgtgggttgagttcaatgaagatgatgggtttctttgtggtggctttaatgttgtgtcagttgttttctcagtatctgtagtgcttcaagacccaccaagtgatggggttttggaatctggtaaaaatgttagatttcttgatgttatggaatctagtaaggaagagcaagttcttgaagtccaaccccagaaaggtccagttgatgatgatgccctgtctattgaggtgcgaaaagataaactgcacggtggacttcttgcagctggatttgatgaaacatcttgtgtcagtaggtaccagtcggtcttataccgcaaagaatcgcaacataaaccttcaccttatctaatctcgaggttacggaattatgaagctctccataaacgatgtgggccatatacagaatcatataacaaaaccttggaaaagctcaagaccgggcatcaccttgaatctacagattgtaattatttagtatggatttcctttagcggattaggaaataggatactgaccctagcctcagcatttctctatgctctccttacaaatcgtgttctactcgttgaccctggaactgatatggttgatcttttttgcgaaccatttccggaggtctcctggtttctccctctggatttcccccttaaaaatcaattcgacagctttgatcagaaatctcctcattgttatggaagaatgctgaagaacaactcttttgctaattcaagcaaatcgatattggcaccttttgtatatctccatctggttcatgattacgatgaccaggataagctttttttctgcgatgaagaccaaacttctctccaggaagtaccgtggttgatcatgaaaacagataactactttgtcccatctctcttcttgatcccgactttcgagcagcaactgagtaatctcttcccgagaaaagaagcagttttccacttattgggtcggtatatcttccacccgacgaatccagtttggggactcataacccgatactatcaagcttatttagctaaagcagatgaaaggataggcatccagatcagggtctttgacactgggaccggtccattccaacatgttttggatcagatcattgcttgtaccttgaaggagaatctactgccggatatcagcacggaaaagccaataatcaatcaatctcagaagtctaaagctgtgctggttacatctttgagtggaggttactttgagagattaagggacatgtactgggaacatccaaccgtgacaggggaggtcatcggtttttaccaaccgagccacgaagagtatcagcaaacagagaagcagtttcacaataggaaagcatgggccgaaatgtatttattgagcttgacagatgtgctgatcacaagctcatggtcaactttcggttatgttgctcaaagccttggaggattgaagccgtggattctgtacaagccggagaactggacggccccagatccaccttgtggtagagtcatgtcaatggagccatgtttccatgccccacccttttatgactgtaaagccaaaagaggcattgacacaggtgcagttgttcctcatgtaagacactgtgaggacatgagttggggtcttaagcttgttgacaatgagagtgagttataagcatagtttcctttttgtataaagtaaaatattaaatcaaatatcccttaaattttcactctgt

SEQ ID NO: 288 - protein, 550 aa, Gossypium hirsutum
  REGION 1..550: note = Ceres Clone ID no. 1925709
  REGION 46..518: note = Pfam Name: XG_FTase Pfam Description: Xyloglucan fucosyltransferase
  REGION 1..550: note = Bit score of 1407.0 for HMM based on sequences of Figure 10
  REGION 1..550: note = Functional Homolog Of SEQ ID NO. 280
  REGION 1..550: note = Figure 10
MWVEFNEDDGFLCGGFNVVSVVFSVSVVLQDPPSDGVLESGKNVRFLDVMESSKEEQVLEVQPQKGPVDDDALSIEVRKDKLHGGLLAAGFDETSCVSRYQSVLYRKESQHKPSPYLISRLRNYEALHKRCGPYTESYNKTLEKLKTGHHLESTDCNYLVWISFSGLGNRILTLASAFLYALLTNRVLLVDPGTDMVDLFCEPFPEVSWFLPLDFPLKNQFDSFDQKSPHCYGRMLKNNSFANSSKSILAPFVYLHLVHDYDDQDKLFFCDEDQTSLQEVPWLIMKTDNYFVPSLFLIPTFEQQLSNLFPRKEAVFHLLGRYIFHPTNPVWGLITRYYQAYLAKADERIGIQIRVFDTGTGPFQHVLDQIIACTLKENLLPDISTEKPIINQSQKSKAVLVTSLSGGYFERLRDMYWEHPTVTGEVIGFYQPSHEEYQQTEKQFHNRKAWAEMYLLSLTDVLITSSWSTFGYVAQSLGGLKPWILYKPENWTAPDPPCGRVMSMEPCFHAPPFYDCKAKRGIDTGAVVPHVRHCEDMSWGLKLVDNESEL

SEQ ID NO: 289 - protein, 558 aa, Arabidopsis thaliana
  REGION 1..558: note = Public GI ID no. 15227566
  REGION 54..532: note = Pfam Name: XG_FTase Pfam Description: Xyloglucan fucosyltransferase
  REGION 1..558: note = Bit score of 1398.9 for HMM based on sequences of Figure 10
  REGION 1..558: note = Functional Homolog Of SEQ ID NO. 280
  REGION 1..558: note = Figure 10
MDQNSYRRRSSPIRTTTGGSKSVNFSELLQMKYLSSGTMKLTRTFTTCLIVFSVLVAFSMIFHQHPSDSNRIMGFAEARVLDAGVFPNVTNINSDKLLGGLLASGFDEDSCLSRYQSVHYRKPSPYKPSSYLISKLRNYEKLHKRCGPGTESYKKALKQLDQEHIDGDGECKYVVWISFSGLGNRILSLASVFLYALLTDRVLLVDRGKDMDDLFCEPFLGMSWLLPLDFPMTDQFDGLNQESSRCYGYMVKNQVIDTEGTLSHLYLHLVHDYGDHDKMFFCEGDQTFIGKVPWLIVKTDNYFVPSLWLIPGFDDELNKLFPQKATVFHHLGRYLFHPTNQVWGLVTRYYEAYLSHADEKIGIQVRVFDEDPGPFQHVMDQISSCTQKEKLLPEVDTLVERSRHVNTPKHKAVLVTSLNAGYAENLKSMYWEYPTSTGEIIGVHQPSQEGYQQTEKKMHNGKALAEMYLLSLTDNLVTSAWSTFGYVAQGLGGLKPWILYRPENRTTPDPSCGRAMSMEPCFHSPPFYDCKAKTGIDTGTLVPHVRHCEDISWGLKLV

SEQ ID NO: 290 - protein, 565 aa, Pisum sativum
  REGION 1..565: note = Public GI ID no. 20138107
  REGION 57..537: note = Pfam Name: XG_FTase Pfam Description: Xyloglucan fucosyltransferase
  REGION 1..565: note = Bit score of 1414.7 for HMM based on sequences of Figure 10
  REGION 1..565: note = Functional Homolog Of SEQ ID NO. 280
  REGION 1..565: note = Figure 10
MNMLIKRVIAIKNPRGDDNNNNKLSDLETLTDKCTTCPLTLMRVMAFFVVSFMLFSVLFSLSVVLRDPPSDAAISSTTTLFQLNQGLGSDDFDSVELLNDKLLGGLLADGFDEKSCLSRYQSAIFGKGLSGKPSSYLISRLRKYEARHKQCGPYTESYNKTVKELGSGQFSESVDCKYVVWISFSGLGNRILTLVSAFLYALLTDRVLLVDPGVDMTDLFCEPFPDASWFVPPDFPLNSHLNNFNQESNQCHGKILKTKSITNSTVPSFVYLHLAHDYDDHDKLFFCDEEQLFLQNVPLLIMKTDNYFIPSLFLMPSFEQELNDLFPKKEKVFHFLGRYLLHPTNNVWGLVVRYYDAYLAKVDERIGIQIRVFDTDPGPFQHVLDQVLACTLKESILPDVNREQNINSSSGTPKSKAVLITSLSSGYFEKVRDMYWEFPTETGEVVGIYQPSHEGYQQTQKQFHNQKAWAEMYLLSLTDVLVTSSWSTFGYVAQGLGGLKPWILYKPENRTAPNPPCQRAMSMEPCFHAPPFYDCKAKRGTDTGALVPHVRHCEDMSWGLKLVDN

SEQ ID NO: 291 - DNA, 1962 bp, Triticum aestivum
  misc_feature 1..1962: note = Ceres Clone ID no. 934069
  misc_feature 1..1962: note = Encodes the peptide sequence at SEQ ID NO. 292
  source 1..1962: mol_type = other DNA
agacatctctgcttagcttcagttggtcagccgaggcacaccggccgcgcgtcggcgatgcagcagcgcaaggcacccaaggcgtccgcggagggcgtcacggagcaggaggcgtcgccggcggccgtgctgccgaggaccgccacggcgcgcgacttgctggaggcggaggaggctccggaccagtgctccatgacgccgcggaagaagaataagaagaggcagacgggcgccggtgagaggcggtgcaggccggtgctcaacctgttgctcgtcgccttcgtcgtggcggtgctgctggcggtcgtccttcttgccgacggcggccgcgttcccgcggtctggatcgccgctgccagagcccagctgcgtcgaggttccggtcacgcctggttaccgtacgcgaggaacgcgccggacaaactcctcggcggcctcctggccgacggagtcgacggcgaaacatgccgcagcaggcacgagtcctccgcgtaccgacggagcacgccgcggcggccatccccgtacctcgtcgcgaagctgcgacggcacgaggagctccagcggcggtgcggccccggcagcgacgcgtacagccgcgccgtccagcagctgagcgccggcaggagcgccgtcgacgccgagtgcaagtacgtcgtctccgtctgcaaccgcggcctcggcaaccgcatcctcgccgccgcgtcggcgttcctctacacgctgctcaccgaccgcgtcctcctcgtctaccggggcaacggcatgggcgacctcttctgcgagccgttccccggcgcgacgtggctgctgcccccggacttcccggtggcgggcctcgccaacatcaccgtcgacgccgccgagacctacggcaacatgctcaagaacaaggtgctcacggcggactccaaggagccggtgcaggtgccggcgttggcgtacgcctaccttgaacacgactacggcgacggcgacaagaggttcttctgcgacgacgaccagcgcctcatgtcaaacatccagtggctggtggcgaggatggacacctacagcgtgccggggctgttccaggtcccgtccttcgcggaggagctcgccgcgctcttcccagagagcgacgccgtgttccaccacctcggccggtacctcttccacccggccgaccacgtctggggcctcgtctcgcggtactaccgcgcctacctcgcgcgggcggagcagctggtgggcgtccaggtgcgcgtcttcgacagcgagcagggcaagtcgccgcacgtcctgcggcagatcacgtcgtgcgtgtggaaggagaagctgctcccggaggtcctcgccgccggtgagccggtcatcacgccggcgaccgggggcatatccaggaccgtcctgatcgcctcgctgaggccgtggttctacgagcgcatcaagagcatgtactgggagcagccgacggcgagcggcgaggacgtgggcgtgcaccagccgagccacgaggagtaccagcagttcggccgaaggtcgcacgacaccaaggcgtgggcggagatgtacctgctcagcctctgcgacgtgctcgtcacctccggctggtccacgttcgggtacgtcgcgcaggggctcgctggcgtcacgccgtgggtcatgtaccgcccgctcaacttcagcgagacaccggacccgccctgcggccgcgacgtgtccatggagccctgcttccacacgccgcccatgtacgattgcaagctcaaacacacggcggacaccgcgaggtcggtgccccatatccggcgatgcgaggacgtgaaatggggcttgaagcttgttggccccaaatagtacgtagtaggcactagttacacggtttcagagcccaaactcgatcacaagtagtaaaattcttctccaatccagacatgcatgtattcagatctttattataatatactacctctgttccgc

SEQ ID NO: 292 - protein, 593 aa, Triticum aestivum
  REGION 1..593: note = Ceres Clone ID no. 934069
  REGION 84..564: note = Pfam Name: XG_FTase Pfam Description: Xyloglucan fucosyltransferase
  REGION 1..593: note = Bit score of 1340.9 for HMM based on sequences of Figure 10
  REGION 1..593: note = Functional Homolog Of SEQ ID NO. 280
  REGION 1..593: note = Figure 10
MQQRKAPKASAEGVTEQEASPAAVLPRTATARDLLEAEEAPDQCSMTPRKKNKKRQTGAGERRCRPVLNLLLVAFVVAVLLAVVLLADGGRVPAVWIAAARAQLRRGSGHAWLPYARNAPDKLLGGLLADGVDGETCRSRHESSAYRRSTPRRPSPYLVAKLRRHEELQRRCGPGSDAYSRAVQQLSAGRSAVDAECKYVVSVCNRGLGNRILAAASAFLYTLLTDRVLLVYRGNGMGDLFCEPFPGATWLLPPDFPVAGLANITVDAAETYGNMLKNKVLTADSKEPVQVPALAYAYLEHDYGDGDKRFFCDDDQRLMSNIQWLVARMDTYSVPGLFQVPSFAEELAALFPESDAVFHHLGRYLFHPADHVWGLVSRYYRAYLARAEQLVGVQVRVFDSEQGKSPHVLRQITSCVWKEKLLPEVLAAGEPVITPATGGISRTVLIASLRPWFYERIKSMYWEQPTASGEDVGVHQPSHEEYQQFGRRSHDTKAWAEMYLLSLCDVLVTSGWSTFGYVAQGLAGVTPWVMYRPLNFSETPDPPCGRDVSMEPCFHTPPMYDCKLKHTADTARSVPHIRRCEDVKWGLKLVGPK

SEQ ID NO: 293 - DNA, 1737 bp, Sorghum bicolor
  misc_feature 1..1737: note = Ceres Annot ID no. 8681691
  misc_feature 1..1737: note = Encodes the peptide sequence at SEQ ID NO. 294
  source 1..1737: mol_type = other DNA
atggacatcaaggagcggatccgccgctcgccgccgccgacgccgaaggcggtaggggaggcggcgtccgcgcccgggcacccgcgcgggaggaagggccgggtcgcgctgctgcccctgtcgatcgcggcgctcgtggcgtgcggggtcacgctgctgctgctcgcgggcggctccgcggcgaggaggggcggccaattctccggcgcggatcgtaccactctctccggcgccggcaacaacgaccgtggcggccttgaccaggccggaccgcgcgatggagagcatgaaactatggtgtcttccaaagttcaaagggacagactaattggtggcttgttagctcctggttttgatgaacagtcatgtctaagtagataccaatcagcattgtaccgtaaagaatcgccccatttgatatcatcataccttctggaaagactgagagaacatgaggttctccagaagaaatgtggcccgtatacagagtcatacaagaaagctattgagcaactaaaatctggtcaggatgttatggttggagattgcaactttttggtatgggtatcttatagtggtcttgggaacaggatcttgactattgcctcagcatttctctatgccatccttacaaacagagttttacttgtagatggagataaaggcactgcagatcttttctgtgaaccattccctgaaacttcatggttattaccaccggatttccctattattcaatttaagaacttcagtattggctcccccgagagtcacggaaacatggtgaaaactgaagctattcattctgatggttcttttaagggtcctaaacctgcctttctatatcttcacctggctcatgactatgatgattatgataaactttttttctgtgagcatagtcagcaacatcttcagaagatcccatggctgatcttaagatccgataattactttgtaccttcactttttctgatcccatcataccaagaggaactcacgaggctgtttccgcagaaagatgtcgttttccatcacttgggacgttacttgttccaccctaccaatgttgtctggggcttgattacaaggtactacgattcttatcttgccagagctgatgagaagttaggtatccagatcagagtcttcgatactgaaaccggtccatttcagcatgtcttggatcaggtccttgattgcacactgaaggaaaaattactaccagagattaacgcacaacagccgattatctcgacagggaacatcaggtccaaagttgttctgattacttctttgaactcaggatactatgaaagaatcaggaacatgtattgggaacatccaacagagagtggtgagataattagcttccaccagccaagtcacgaggagcatcaggattcagacaagaaaatgcataacatgaaagcattggcagagatttatctgttgagcttatctgatgttatggtaacaagtgcatggtcaacttttgggtatgtagctcaaggtctgagtggttcgaagacgtggctaatgttcaagccggaaaaccgcactgcgcctaatccaccttgccgtcaagttatgtctatagagccgtgctttcatgctccacctttctacgattgcaaaactaggaagggaactgatacaggaaagcttgttccacatgtaagacactgtgaagatatgagctgggggctcaagctagttgatacgggtgagctgtag

SEQ ID NO: 294 - protein, 578 aa, Sorghum bicolor
  REGION 1..578: note = Ceres Annot ID no. 8681691
  REGION 74..547: note = Pfam Name: XG_FTase Pfam Description: Xyloglucan fucosyltransferase
  REGION 1..578: note = Bit score of 1172.1 for HMM based on sequences of Figure 10
  REGION 1..578: note = Functional Homolog Of SEQ ID NO. 280
MDIKERIRRSPPPTPKAVGEAASAPGHPRGRKGRVALLPLSIAALVACGVTLLLLAGGSAARRGGQFSGADRTTLSGAGNNDRGGLDQAGPRDGEHETMVSSKVQRDRLIGGLLAPGFDEQSCLSRYQSALYRKESPHLISSYLLERLREHEVLQKKCGPYTESYKKAIEQLKSGQDVMVGDCNFLVWVSYSGLGNRILTIASAFLYAILTNRVLLVDGDKGTADLFCEPFPETSWLLPPDFPIIQFKNFSIGSPESHGNMVKTEAIHSDGSFKGPKPAFLYLHLAHDYDDYDKLFFCEHSQQHLQKIPWLILRSDNYFVPSLFLIPSYQEELTRLFPQKDVVFHHLGRYLFHPTNVVWGLITRYYDSYLARADEKLGIQIRVFDTETGPFQHVLDQVLDCTLKEKLLPEINAQQPIISTGNIRSKVVLITSLNSGYYERIRNMYWEHPTESGEIISFHQPSHEEHQDSDKKMHNMKALAEIYLLSLSDVMVTSAWSTFGYVAQGLSGSKTWLMFKPENRTAPNPPCRQVMSIEPCFHAPPFYDCKTRKGTDTGKLVPHVRHCEDMSWGLKLVDTGEL

SEQ ID NO: 295 - protein, 572 aa, Oryza sativa
  REGION 1..572: note = Public GI ID no. 46805726
  REGION 85..541: note = Pfam Name: XG_FTase Pfam Description: Xyloglucan fucosyltransferase
  REGION 1..572: note = Bit score of 1156.9 for HMM based on sequences of Figure 10
  REGION 1..572: note = Functional Homolog Of SEQ ID NO. 280
  source 1..572: note = Oryza sativa subsp. japonica
MDLKERIRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGGLLTTGFDEQSCLSRYQSVLYRKASSHFPSAYLLERLREHEALQKKCGPHTESYKKAIEQLKAGQGAKVMECNYLVWVAYSGLGNRILTMASAFLYAILTRRVLLVDSDKGTADLFCEPFPETSWLLPPKFPIKQFKNFSNGSPESYGNMLKNKAIRSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSYLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVSHCEDMSWGLKLVDQSEW

SEQ ID NO: 296 - protein, 574 aa, Oryza sativa
  REGION 1..574: note = Public GI ID no. 125541250
  REGION 85..541: note = Pfam Name: XG_FTase Pfam Description: Xyloglucan fucosyltransferase
  REGION 1..574: note = Bit score of 1080.0 for HMM based on sequences of Figure 10
  REGION 1..574: note = Functional Homolog Of SEQ ID NO. 280
  source 1..574: note = Oryza sativa subsp. indica
MDLKERIRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGGLLTTGFDEQSCLSRYQSVLYRKASSHFPSAYLLERLREHEALQKKCGPHTESYKKAIEQLKAGQGAKVMECNYLVWVAYSGLGNRILTMASAFLYAILTRRVLLVDIDKGTADLFCEPFPETSWLLPPKFPIKQFKNFSNGSPESYGNMLKNKAIHSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSYLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVTLYLSYRKAIFDMVNTNAVV

SEQ ID NO: 297 - protein, 608 aa, Oryza sativa
  REGION 1..608: note = Public GI ID no. 115448869
  REGION 75..575: note = Pfam Name: XG_FTase Pfam Description: Xyloglucan fucosyltransferase
  REGION 1..608: note = Bit score of 1135.2 for HMM based on sequences of Figure 10
  REGION 1..608: note = Functional Homolog Of SEQ ID NO. 280
  source 1..608: note = Oryza sativa subsp. japonica
MQVQQRKPKACAESAAAARGADQQQCDGRPLEAGEESLERSVPRKRKPAAAVAAAEKRWSSVAYVVLAAFVMATVFAVLGGRRPAVWIAATKALRRGSDDKSIPLARSAADKLLGGLLPEGFDEKSCRSRYESYLYRRNPGRRPSPHLVARLRMHEELQRRCGPNTESYNRAVQRLRDGGAAEADAHSPDDEQCKYVVSISYRGLGNRILAAASAFLYAVLTGRVLLVDPSNEMDELFCEPFPGTTWLLPRDFPLASSYANFSADTAESYGNMLKNKVLGTDGSTDGDMPAAQMPAFAYLHLDHDYGDGDKMFFCDDDQRLLSNIQWLVMRTDTYIVPSLFLVTTFQDELDALFPERDAVFHHLGRYLFHPANHVWGLVARYYRAYLATARQLVGVQVRVFDHRQAKSPHVVLEQITSCAWKEKLLPEVLDAVEDAAMPTPPTTPHGGSNNSKAVLITSLRPWFYERVKAMYWERATATGEDVSVHQPSHEEYQHFGEKSHDGKAWAEMYLLSLCDVLVTSGWSTFGYVAQGLGGLRPWVMYKPVNITAVPDPPCGRDVSMEPCFHSPPFYDCKTKRGVDTGTILPHVRHCDDVSWGLKLVDPNGSPN

SEQ ID NO: 298 - protein, 591 aa, Oryza sativa
  REGION 1..591: note = Public GI ID no. 115467048
  REGION 67..562: note = Pfam Name: XG_FTase Pfam Description: Xyloglucan fucosyltransferase
  REGION 1..591: note = Bit score of 1068.4 for HMM based on sequences of Figure 10
  REGION 1..591: note = Functional Homolog Of SEQ ID NO. 280
  source 1..591: note = Oryza sativa subsp. japonica
MGSGGAAAAAAAVPLRKEKQRSAAGRWPEVEDGVVPATAKRHVRRAWRCGVNVVLAAFVMVVPPMVILLDARGAGAPAVWISSVNAFRRGDGSILQWPAAAAARDKLLGGLLADGLDDGSCHSRYQSAMYRRNAGREPSPHLVSKLRRHEELQRRCGPGTAAYSDAVERLRSGKSGGIVSPSPEAECRYLVSISYRGLGNRILAAASAFLYAMLTDRVLLVDPSNEMDELFCEPFPGATWLLPPGFPLANYTSFSVETAESYGNMVKNKVITTDAGDAAPTTAQLPAFAYIHLDHTSTVEDKFFFCDEDQRAIRNIPWLVMRTDSYIVPGLFLVTGFQDELDSLFPETDAVFHHLGRYLFHPTNHVWGLVTRYYDAYLATAQQRVGIQVRVFGAQPESPKLLDQITTCTQKEKLLPEVIAAGEPPVVDVAPANSKSKAVLVTSLKSWYYEKMKSMYWEHATATGEAVSVHQPSHEEYQRFGARSHDGKAWAEIYLLSLSDALVTSGWSTFGYVAQGLAGLTPWVMHKPANDTAAAAGDDPPCRRDVSMEPCFHAPPFYDCRLKRGADTGKMVPHVRHCDDVQWGLKLVRRG

SEQ ID NO: 299 - protein, 591 aa, Oryza sativa
  REGION 1..591: note = Public GI ID no. 51090521
  REGION 65..561: note = Pfam Name: XG_FTase Pfam Description: Xyloglucan fucosyltransferase
  REGION 1..591: note = Bit score of 990.5 for HMM based on sequences of Figure 10
  REGION 1..591: note = Functional Homolog Of SEQ ID NO. 280
  source 1..591: note = Oryza sativa subsp. japonica
MRRHEATIGGDGAAAPWKEQQLASHRWPEAQEGAPAFPPSTMRRLVYSAANAALVVFIMTVPPMVVLYGARSSSPAVWISSANVGGRGSSSDESILLLHRPAAAHDKLLGGLLADGFDEGSCHSRYQSAMYRRNNAGKEPSPHLVSRLRRHEELQRRCGPGTAAYSNAVESLRSGKSGGIGSPPQTECRYLVSISYRGLGNRMLAAASAFLYAMLTDRVLLVDPSNEMGELFCEPFPGTTWLLPPGFPLTNFTSFSVDTTESYGNMLKNKVITTDAAAGDVPTPHQQLPAFAYIHLDHDYTFHDKFFFCDDDQSVLRNVPWLVMRTDSYIVPGLFLVTGFQAELDSLFPETDAVFHHLARYLFHPNNHIWGLVTRYYDAYLATARQRVGVQVRVFGARQESPKVLEQITACAHMENLLPDVITTGEPAATTRRRLKPKAVLVTSLTSWYYEKLKGMYWERATATGEAVGVHQPSHEEYQRFGSGSHDAKACAEIYLLSLSDALVTSGWSTFGYVAQGLAGLTPRVMYKPANESSAVPDPPCRRDVSMEPCFLTPPYNNCRMKRSAHSGKVVAHVKNCHDVPWGLKLVRRVE

SEQ ID NO: 300 - protein, 565 aa, Oryza sativa
  REGION 1..565: note = Public GI ID no. 125554524
  REGION 47..536: note = Pfam Name: XG_FTase Pfam Description: Xyloglucan fucosyltransferase
  REGION 1..565: note = Bit score of 912.4 for HMM based on sequences of Figure 10
  REGION 1..565: note = Functional Homolog Of SEQ ID NO. 280
  source 1..565: note = Oryza sativa subsp. indica
MNSEGGIGAGITNRPSQQCSAAAAEDGDDYERPCPWIPGKKKKKKITCLAICLIASPILILLVSRRGSPFPSMSGWALPSRMYASKGSKRDVLMGGLLVPGLDERTCASRYSSAMYRKNTARSPCRHLVKRLREQEALQRRCGPGTAAYWRAAERLGSRRNGTAGADDEGCKYLVLVPYRGLGNRMLAMASAFLYAMLTGRALLVDRGESLADLFCEPFPGTSWLLPPEFPIKNLQDLTGEAPESYRNLVQSDRPATSVSELPYVFVDLDHGCTYHDKLFYCDDERHFLHRAPWLLMRTDGYFPPALFLNPAYQDELDRLFPRKDSVFYLLAHYLLHPTNKVWGLITRFYDSYLRDSDERLGIQVRVFDGDTPFKHILDQITACTSQERLLPEVVEQEPSSFPAPAAAATAARSKAVLMTGLNSWYYDNIRSRYWQSPTATGEVVRVHQPSHEEHQLSGSTTHDMKAMAEMYLLSMTDAIVTSGWSTFGYVGHGLGGLSPWVMFKPENLTTPDPPCRRAVSMEPCLHGPPFYDCRVKRGADTGKLVPHVRHCEDMSWGLKLVHPE

SEQ ID NO: 301 - DNA, 1764 bp, Sorghum bicolor
  misc_feature 1..1764: note = Ceres Annot ID no. 8735787
  misc_feature 1..1764: note = Encodes the peptide sequence at SEQ ID NO. 302
  source 1..1764: mol_type = other DNA
atggccttggagggcgtggtcggcattggcatagccaagcggccatcactgcaatgcctggacgccgtggagaacgcggcccgacgtgccgagccagacgagcgtacggtggagcagagcacaacgccatggatgatcgcgaggaagaaggtcacagcgctcgccgtctgcctcgtcgcgttgcccgtcctgatgaccacggttagccggcgggactcgccgtggacgcccgcgtccttttggccgctggcgacattcgcgcggcaagatcttctgactcgcggtgctttgaaacgatttcgattgaaaagagctctaatctaccttccccgcgtgcgaaaattcgatgcagagaagctcctcggcggcctgctcgtgccggggttcgacgagcggtcatgcctcagccggtaccagtcagcgttctaccgcaagaacctgacgcggtcgccgtccgcgcacctcatcaagcggctgcgccagcacgaggcgctgcagcgccggtgtgggccgggcaccgaggcgtacagggcggcggccgcgcggctcaggtcctggcgccgcaacggcaccgacgtcgacgccgcctgcaggtacctcgtgctggtgccgtacaggggcctcgggaacaggatcctggccgtggcgtcggcgttcctctacgccgtgctcaccgaccgcgtcctgctcctcgacgggaacacgtcgacgggcgaaatcttctgcgagccgttcccggggacctcgtggctgctgccgctgaacttccccatcagcaacctccagaacctgacgggcgacgtgcgggagagctacaggaacctggtgcggaacgatagcgcggcggcgtcgctggcgtccaggctcccgtacgtgttcgtggacctcgaccattcctgcacctaccacgacaagctcttcttctgcgacgacgagcggccgttcctccgccgcgcgccgtggctggtgatgaggacggacggctacttcgtgccggcgctgttcctgaacccggcgcaccaggacgagctccacaggatgttccctcggaaggactcggtgttctacctgctggcgcactacctgttccacccgacgaacaaagtttggggactcatcacgaggttccacagctcgtacctgagggactcggacgaaaggctgggcatccaggtgagggtgttcgacggggacacgccgttccagcacatcttggagcagatcctcgcctgcacgtcgcaagagcacctgctccccgacgtggtcacgcaagaaccgccccgcccgtcgacggccggtgcgcggtccaaggccgtcctgatgaccggcctgagctcgtggtactacgagaacatccggtggaagtactggcagtcggcgacggccaccggcgaggtcgtgagcgtgtaccagccgagccacgaggagcaccagctctccggctacacgacgcacgacatgaaggcggtggcggagatgtacctcctgggcatgacggacaagatcgtcaccagcggctggtcgacgttcggctacgtcggccacggcctcggtgggctcacgccgtggatcatgttcaggcctgagaaccacaccacgccttacccgccgtgccggcgggccaagtcgatggagccgtgcatgcacgggccgccgttctacgactgcagggcgaagcacggtgccgacacgggaaagctggtgccacatgtccagcactgtgaagacatgagctgggggctgaaacttgttcaccccgagtga

SEQ ID NO: 302 - protein, 587 aa, Sorghum bicolor
  REGION 1..587: note = Ceres Annot ID no. 8735787
  REGION 79..558: note = Pfam Name: XG_FTase Pfam Description: Xyloglucan fucosyltransferase
  REGION 1..587: note = Bit score of 937.4 for HMM based on sequences of Figure 10
  REGION 1..587: note = Functional Homolog Of SEQ ID NO. 280
MALEGVVGIGIAKRPSLQCLDAVENAARRAEPDERTVEQSTTPWMIARKKVTALAVCLVALPVLMTTVSRRDSPWTPASFWPLATFARQDLLTRGALKRFRLKRALIYLPRVRKFDAEKLLGGLLVPGFDERSCLSRYQSAFYRKNLTRSPSAHLIKRLRQHEALQRRCGPGTEAYRAAAARLRSWRRNGTDVDAACRYLVLVPYRGLGNRILAVASAFLYAVLTDRVLLLDGNTSTGEIFCEPFPGTSWLLPLNFPISNLQNLTGDVRESYRNLVRNDSAAASLASRLPYVFVDLDHSCTYHDKLFFCDDERPFLRRAPWLVMRTDGYFVPALFLNPAHQDELHRMFPRKDSVFYLLAHYLFHPTNKVWGLITRFHSSYLRDSDERLGIQVRVFDGDTPFQHILEQILACTSQEHLLPDVVTQEPPRPSTAGARSKAVLMTGLSSWYYENIRWKYWQSATATGEVVSVYQPSHEEHQLSGYTTHDMKAVAEMYLLGMTDKIVTSGWSTFGYVGHGLGGLTPWIMFRPENHTTPYPPCRRAKSMEPCMHGPPFYDCRAKHGADTGKLVPHVQHCEDMSWGLKLVHPE

SEQ ID NO: 303 - protein, 539 aa, Arabidopsis thaliana
  REGION 1..539: note = Public GI ID no. 15227563
  REGION 24..510: note = Pfam Name: XG_FTase Pfam Description: Xyloglucan fucosyltransferase
  REGION 1..539: note = Bit score of 1021.8 for HMM based on sequences of Figure 10
  REGION 1..539: note = Functional Homolog Of SEQ ID NO. 280
MRITEILALFMVLVPVSLVIVAMFGYDQGNGFVQASRFITMEPNVTSSSDDSSLVQRDQEQKDSVDMSLLGGLLVSGFKKESCLSRYQSYLYRKASPYKPSLHLLSKLRAYEELHKRCGPGTRQYTNAERLLKQKQTGEMESQGCKYVVWMSFSGLGNRIISIASVFLYAMLTDRVLLVEGGEQFADLFCEPFLDTTWLLPKDFTLASQFSGFGQNSAHCHGDMLKRKLINESSVSSLSHLYLHLAHDYNEHDKMFFCEEDQNLLKNVPWLIMRTNNFFAPSLFLISSFEEELGMMFPEKGTVFHHLGRYLFHPSNQVWGLITRYYQAYLAKADERIGLQIRVFDEKSGVSPRVTKQIISCVQNENLLPRLSKGEEQYKQPSEEELKLKSVLVTSLTTGYFEILKTMYWENPTVTRDVIGIHQPSHEGHQQTEKLMHNRKAWAEMYLLSLTDKLVISAWSTFGYVAQGLGGLRAWILYKQENQTNPNPPCGRAMSPDPCFHAPPYYDCKAKKGTDTGNVVPHVRHCEDISWGLKLVDNF

SEQ ID NO: 304 - DNA, 1917 bp, Sorghum bicolor
  misc_feature 1..1917: note = Ceres Annot ID no. 8681690
  misc_feature 1..1917: note = Encodes the peptide sequence at SEQ ID NO. 305
  source 1..1917: mol_type = other DNA
atgcagcaacgcaaggccaaggtcgtctggggcggcgccgagagcgcggcggcgcaggagatcccggcgatggcgatggcacgcaacggcagctggcctgaggtcgaaggagcctcggagcactcaccagtgccgcggaagaagaggctggccctggacgagaagcggtggaacactgtggtcaatgtcatgctcgtcgccttcgtcatggctgtgccgccggtcatcgttgtcttcgctgggggcggcatcgtgccatcggtctggatcgcggccgccaaggcccagctgcgccgaggttccagccatgtctccttcccgtacgcaagaaacccacctgacaaacttctcggtggcctcctgcccgatggactcgacgagagatcatgccgcagcaggtacgagtcttccatgtacagccggaacccggcacggcgaccttctccgcacctcatagcaaagctgcggagacacgaagagctccagagacggtgcgggccgaacaccgacgcgtacagccgcgccgtccagcacctgagggccggcaagagcgtcgactcgcccgagtgcaagtacgtggtctccatctcgtaccgcggcctcggcaaccgcatcctggccgccgcgtcggcgttcctctacgcggtgctcaccgaccgcgtcctcctcgtggacccgagcaacgagatggacgagctcttctgcgagcctttccccggcacgacgtggctgctaccgcggcgggacttccccctggcgagctacaccaacttcagcatcgacaccgccgagagctacggcaacatgctgaagaacaaggtgctcagcgccgacgtgccgctgccggcgttcgtgtacctccacctcgaccacgactacggcgacgaggacaagatgttcttctgcgacgacgaccagcggctgctgtcgaacgtgcagtggctggtcatgaggaccgacatgtacaccgtgccggggctgttcctggtcacggcgttccaggaggagctcgacatgctgttcccggagcgcgacgccgtgttccaccacctggcgcggtacctgttccacccaaccaaccacgtctggggcctcgtcacgcggtactaccgcgcgtacctctcccgggcggagctccggctcggcgtccaggtgcgcaacttcgacccctggacgctggagtcgccggtcgtcctccggcagatcacgtcgtgcctgtggaaggagaagctgctcccggaggttcttgacacggaagagcgctccatgccgctgatgccgggcggcagcaccagaaccacggccgttctagtcacctctctccggtcgtggtactacgaacgcatcaaggggctgtactgggatcgcgcgacggcgaccggcgaggacgtgagcgtgcaccagccgagccacgaggggcagcagcagtacggcaagaagtcgcacgacgacagggcctgggcggagatgtacctgctgagcctgtgcgacgtgctggtgaccagcggctggtccacgttcgggtacgtcgcgcaggggatcggcggcatgacgccgtgggtgttgcacaagcccacgaacgtcacgtcgccgccggaaccgccgtgcttccgggacatgtccatggagccgtgcttccacgcgccgcacgtctacgactgcaagctgaagcgtggagccgacacagggaaaatgctgccgcacgtcaggaactgcgaggacgctagtggaggtggagtagtggtgatgtatggctccccttatgaggaaggtatgttttttggcaccattgctctaggatccaaagcttttagtgaccatgttcctttaattattgactttggagttcatgaggatataactaaccttccgcgctggatgctaggagacttgctacaatttgatgggacaacatag

SEQ ID NO: 305 - protein, 638 aa, Sorghum bicolor
  REGION 1..638: note = Ceres Annot ID no. 8681690
  REGION 85..556: note = Pfam Name: XG_FTase Pfam Description: Xyloglucan fucosyltransferase
  REGION 1..638: note = Bit score of 1046.6 for HMM based on sequences of Figure 10
  REGION 1..638: note = Functional Homolog Of SEQ ID NO. 280
MQQRKAKVVWGGAESAAAQEIPAMAMARNGSWPEVEGASEHSPVPRKKRLALDEKRWNTVVNVMLVAFVMAVPPVIVVFAGGGIVPSVWIAAAKAQLRRGSSHVSFPYARNPPDKLLGGLLPDGLDERSCRSRYESSMYSRNPARRPSPHLIAKLRRHEELQRRCGPNTDAYSRAVQHLRAGKSVDSPECKYVVSISYRGLGNRILAAASAFLYAVLTDRVLLVDPSNEMDELFCEPFPGTTWLLPRRDFPLASYTNFSIDTAESYGNMLKNKVLSADVPLPAFVYLHLDHDYGDEDKMFFCDDDQRLLSNVQWLVMRTDMYTVPGLFLVTAFQEELDMLFPERDAVFHHLARYLFHPTNHVWGLVTRYYRAYLSRAELRLGVQVRNFDPWTLESPVVLRQITSCLWKEKLLPEVLDTEERSMPLMPGGSTRTTAVLVTSLRSWYYERIKGLYWDRATATGEDVSVHQPSHEGQQQYGKKSHDDRAWAEMYLLSLCDVLVTSGWSTFGYVAQGIGGMTPWVLHKPTNVTSPPEPPCFRDMSMEPCFHAPHVYDCKLKRGADTGKMLPHVRNCEDASGGGVVVMYGSPYEEGMFFGTIALGSKAFSDHVPLIIDFGVHEDITNLPRWMLGDLLQFDGTT

SEQ ID NO: 306 - protein, 509 aa, Arabidopsis thaliana
  REGION 1..509: note = Public GI ID no. 15223062
  REGION 3..475: note = Pfam Name: XG_FTase Pfam Description: Xyloglucan fucosyltransferase
  REGION 1..509: note = Bit score of 940.9 for HMM based on sequences of Figure 10
  REGION 1..509: note = Functional Homolog Of SEQ ID NO. 280
MLLLLSFSNIFKHQLLGATINVGSKDSVKPRDRLLGGLLTADFDEDSCLSRYQSSLYRKPSPYRTSEYLISKLRNYEMLHKRCGPGTDAYKRATEKLGHDHENVGDSSDGECKYIVWVAVYGLGNRILTLASVFLYALLTERIILVDQRKDISDLFCEPFPGTSWLLPLDFPLMGQIDSFNREYSHCYGTMLKNHTINSTTIPSHLYLHLLHDYRDQDKMFFCQKDQSLVDKVPWLVVKSNLYFIPSLWLNPSFQTELIKLFPQKDTVFYHLARYLFHPTNQVWGMVTRSYNAYLSRADEILGIQVRVFSRQTKYFQHVMDQIVACTQREKLLPEFAAQEEAQVTNTSNPSKLKAVLVTSLNPEYSNNLKKMYWEHPTTTGDIVEVYQPSRERFQQTDKKLHDQKALAEMYLLSLTDKLVTSALSTFGYVAQGLGGLKPWILYTPKKFKSPNPPCGRVISMEPCFLTPPVHGCEAKKGINTAKIVPFVRHCEDLRHYGLKLVDDTKNEL

SEQ ID NO: 307 - DNA, 1662 bp, Sorghum bicolor
  misc_feature 1..1662: note = Ceres Annot ID no. 8735782
  misc_feature 1..1662: note = Encodes the peptide sequence at SEQ ID NO. 308
  source 1..1662: mol_type = other DNA
atggcgaagctgctggtcgacgtcaacgtcaagcggcggagctgggcggtcagtgccgtgctcgccgccgtcgtgatgaccgtgcctctcttcgtcatcatccacagtgattttggagcgtcggggatttggattcagactgccgtggccggcttacgcaaaggttcaaatgatctctccatgcagccgaggtcagcgcggcgccacgataagcttctcggcggcctactggtcgacggcttcgacgaagaatcctgccacagccggtaccaatccgccatgtaccgtcgaaaccccggcaggcaaccctcgacgtacctcatctccaagctccggcggcacgagtccctgcaaaggcggtgtggtccaggcaccgccgcctacagcaacgcccttgcgcagctgaaatccggcaagagcgtcgcgtctccgccggagtgcaggtacatagtctccgtgcccatcgaaggcctcggcaacaggatgctcgccgccgcgtcggcgttcctgtacgcgctgctcacggaccgtgtcgtcctcgtcgaccccagcaacgacatggacaacctgttctgcgagccgttcctcggagccacgtggctgctgccgccggacggcttcccgctggcaagctacgccaacttcagcatcgacaccgccgagacctacgggaacatgctgaagaacaaggtgatcggcgcgggcgcggacgccggcgcgcatgcgcaggtgccggcgttcgcgtacgtgtacctccacagcgacgccggcatccacgacaagaacttcttctgggacgaagaccagaggctgctccggcgcgtgcagtggctggtgatgaggacggacaactacatcgtgccggggctgtttctcaccaaggcgttccaggacgagctcgacctgatgttcccggagcgcgacgccgtgttccaccacctggcccggtacctgttccaccccaacaaccacgtctggggcctcgtcgcgcgctactacgacgcctacctcgccggcgccacgcagctcgtcggcatccaggtgcgcgtcttcggcgcccagccgaactcgccggagctcctggagcagatcacctcgtgcgcgcagaagcacaagctgctcccggaagtgctcgcgacgggaggtgagccgacgatgttgccagcggcgtcccgtgatgccaaggagtctaaatctaaagccgttctcgtcacgtccctcaagccctggtaccaggagaagatgaggagcatgtactgggagcacgcgacggccacaggggaggtggtgagcgtgcaccagccgagccacgaggagtaccagcggttcggcgtcaagtcgcacgacaccaaggcgtgggcggagatctacctgctgagcctgacggacgtgctggtgaccaccagccagtccacgttcgggtacgtcgcccaggggctcggtggcctgaggccgtgggtgatgtacaagccggcgaacggcacagtggtgccggacccgccgtgcggccgggacgtgtcaatggacccgtgttttttccagccgccgaagtacaatttctggcagaaccaatggctggatgccagtaagattgtgccacacgtccagcgctgccccgacttcccttgggggggactgaagcttgttggtgggaatgaatag

SEQ ID NO: 308 - protein, 553 aa, Sorghum bicolor
  REGION 1..553: note = Ceres Annot ID no. 8735782
  REGION 30..522: note = Pfam Name: XG_FTase Pfam Description: Xyloglucan fucosyltransferase
  REGION 1..553: note = Bit score of 931.4 for HMM based on sequences of Figure 10
  REGION 1..553: note = Functional Homolog Of SEQ ID NO. 280
MAKLLVDVNVKRRSWAVSAVLAAVVMTVPLFVIIHSDFGASGIWIQTAVAGLRKGSNDLSMQPRSARRHDKLLGGLLVDGFDEESCHSRYQSAMYRRNPGRQPSTYLISKLRRHESLQRRCGPGTAAYSNALAQLKSGKSVASPPECRYIVSVPIEGLGNRMLAAASAFLYALLTDRVVLVDPSNDMDNLFCEPFLGATWLLPPDGFPLASYANFSIDTAETYGNMLKNKVIGAGADAGAHAQVPAFAYVYLHSDAGIHDKNFFWDEDQRLLRRVQWLVMRTDNYIVPGLFLTKAFQDELDLMFPERDAVFHHLARYLFHPNNHVWGLVARYYDAYLAGATQLVGIQVRVFGAQPNSPELLEQITSCAQKHKLLPEVLATGGEPTMLPAASRDAKESKSKAVLVTSLKPWYQEKMRSMYWEHATATGEVVSVHQPSHEEYQRFGVKSHDTKAWAEIYLLSLTDVLVTTSQSTFGYVAQGLGGLRPWVMYKPANGTVVPDPPCGRDVSMDPCFFQPPKYNFWQNQWLDASKIVPHVQRCPDFPWGGLKLVGGNE

SEQ ID NO: 309 - protein, 556 aa, Oryza sativa
  REGION 1..556: note = Public GI ID no. 115467046
  REGION 32..527: note = Pfam Name: XG_FTase Pfam Description: Xyloglucan fucosyltransferase
  REGION 1..556: note = Bit score of 868.9 for HMM based on sequences of Figure 10
  REGION 1..556: note = Functional Homolog Of SEQ ID NO. 280
  source 1..556: note = Oryza sativa subsp. japonica
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDELAALFPERDAVFHHLGRYLFHPTNHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGTSTFGYVAQGLGGLTPWVLPRREVNGTAPPCRRDMSMEPCFHVAPLYDCKRWEDAGKIVPHVRHCHDMPAGLKLVDRTEW

SEQ ID NO: 310 - protein, 556 aa, Oryza sativa
  REGION 1..556: note = Public GI ID no. 125554519
  REGION 32..527: note = Pfam Name: XG_FTase Pfam Description: Xyloglucan fucosyltransferase
  REGION 1..556: note = Bit score of 868.3 for HMM based on sequences of Figure 10
  REGION 1..556: note = Functional Homolog Of SEQ ID NO. 280
  source 1..556: note = Oryza sativa subsp. indica
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDELAALFPERDAVFHHLGRYLFHPTNHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGKSTFGYVAQGLGGLTPWVLPRREVNGTAPPCRRDMSMEPCFHVAPLYDCKRWEDAGKIVPHVRHCHDMPAGLKLVDRTEW

SEQ ID NO: 311 - protein, 556 aa, Oryza sativa
  REGION 1..556: note = Public GI ID no. 125596466
  REGION 32..527: note = Pfam Name: XG_FTase Pfam Description: Xyloglucan fucosyltransferase
  REGION 1..556: note = Bit score of 865.8 for HMM based on sequences of Figure 10
  REGION 1..556: note = Functional Homolog Of SEQ ID NO. 280
  source 1..556: note = Oryza sativa subsp. japonica
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDDLAALFPERDAVFHHLGRYLFHPTNHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGTSTFGYVAQGLGGLTPWVLPRREVNGTAPPCRRDMSMEPCFHVAPLYDCKRWEDAGKIVPHVRHCHDMPAGLKLVDRTEW

SEQ ID NO: 312 - protein, 500 aa, Arabidopsis thaliana
  REGION 1..500: note = Public GI ID no. 20138442
  REGION 1..475: note = Pfam Name: XG_FTase Pfam Description: Xyloglucan fucosyltransferase
  REGION 1..500: note = Bit score of 905.8 for HMM based on sequences of Figure 10
  REGION 1..500: note = Functional Homolog Of SEQ ID NO. 280
MQLSFFNIFNYQLLDATTNGSKDSRKSKDKLLGGLLTADFDEDSCLSRYESSLYRKPSPYKPSRYLVSKLRSYEMLHKRCGPGTEAYKKATEILGHDDENHSTKSVGECRYIVWIAVYGLGNRILTLASLFLYALLTDRIMLVDQRTDISDLFCEPFPGTSWLLPLDFPLTDQLDSFNKESPRCYGTMLKNHAINSTTTESIIPSYLCLYLIHDYDDYDKMFFCESDQILIRQVPWLVFNSNLYFIPSLWLIPSFQSELSKLFPQKETVFHHLARYLFHPTNQVWGMITRSYNGYLSRADERLGIQVRVFSKPAGYFQHVMDQILACTQREKLLPEVFVLETQVTNTSRSSKLKAVLVTSLYPEYSEILRQMYWKGPSSTGEIIQIYQPSQEIYQQTDNKLHDQKALAEIYLLSLTDYIVTSDSSTFGYVAQGLGGLKPWILYKPKNHTAPEPPCVRAVSMEPCFLRAPLYGCQAKKVNITPFVMYCEDRITGLKLVDSN

SEQ ID NO: 313 - DNA, 1704 bp, Populus balsamifera
  misc_feature 1..1704: note = Ceres Annot ID no. 1448326
  misc_feature 1..1704: note = Encodes the peptide sequence at SEQ ID NO. 314
  source 1..1704: mol_type = other DNA
atgtctgacatggtttcaaatgaattttcagggatgatcagcaccataagagatcaaacttcctggaacaggaaaggctctcaattcaaagtgcagagaaatggatattgttcaataatcccatttgcttgtttgatagttttttctattctagtaatagtcttaatcgttcagcagaggagtacaacattcaaagttaatggaggagatgctaaaattaatgccttggcgggaggagctgctcaaactgagacatcaggagttgtagattcaggaaatgtttcatctcaacaacttcttgacgaactttttgctcctggacatgacaaaggatcttgcttaagccggtatgaagccatcctatttcggaaaccctcctctcataagccctctccctacctcctctccaaacttaggaactatgaaagtcttcataacctctgcgggccttataccgaagcctacaacaaaaccctcgagcaactcaattctggccgtaaggccagtaccacagattgtaactatgttgtctatacacctttaagtggcctagggaacaggatgctgaccattgcctcagcatttctttacgctctcctcacaaaccgagtcctactagtggaattcggaagtgaaattgccggtctgttttgtgagccatttcagcaaacaacatggttattgcctagggattttcccttaaggaatcagtttgacaatttcagccaggaatatcctcatacatatggaaacatgctgaagagtagaatcataaacactgccgtgaagtcttcaccaccaccatttctttatatttatctagcttacaacattgatcgttacgacgggcttttttactgtgatcaaaatcaagatcaacttggaaaggtcccttggttggttataaaatcaaaccagtactttgttccttctctcttcttagtcccatcttttaagcaggaactaagcaagttgttccctgatgaagaaactgtttttcatcacttgggtcgctaccttttccaaccctcaaatgaagcatggggacttatcactaggttctatcgagcttacttatccaaagcagatgagacgattggcatccaagtacgagtcttcgatactaaagctactccatttaaaacagttatggatcagattttgtcctgtactctaaaggagaaactacttcctgaagtcttggatgtgcaaaattctgctgcttctttgtccaataaccaaggcttgaaagctgttttagtaacatctttgtactcagagtactatgagcatataaagggaatgtattggacaaaaccaactgtgagtggggaggtgattggtgtttaccagccaagccatgaagagcatgaaatttacgggaataacatgcacagcatgaaggcatggactgaaatttatctgctaagtatgagtaatgtactgattacaagttcttggtcaacatttggttatgtggctcaaagtctaggtggtttgaagccatggatgctttacaggcctttgaacggaacaaccccagatcctccttgtgtgcaagctatgtcaatggagccttgctttcatttccctccaagctatggctgcaaggcagatgtctacattggtcccggtgctattgttcctcatgtgaagcattgtgaggatgtggaatggggattaaagctcgttaaagatcattga

SEQ ID NO: 314 - protein, 567 aa, Populus trichocarpa
  REGION 1..567: note = Ceres Annot ID no. 1448326
  REGION 56..538: note = Pfam Name: XG_FTase Pfam Description: Xyloglucan fucosyltransferase
  REGION 1..567: note = Bit score of 969.6 for HMM based on sequences of Figure 10
  REGION 1..567: note = Functional Homolog Of SEQ ID NO. 280
MSDMVSNEFSGMISTIRDQTSWNRKGSQFKVQRNGYCSIIPFACLIVFSILVIVLIVQQRSTTFKVNGGDAKINALAGGAAQTETSGVVDSGNVSSQQLLDELFAPGHDKGSCLSRYEAILFRKPSSHKPSPYLLSKLRNYESLHNLCGPYTEAYNKTLEQLNSGRKASTTDCNYVVYTPLSGLGNRMLTIASAFLYALLTNRVLLVEFGSEIAGLFCEPFQQTTWLLPRDFPLRNQFDNFSQEYPHTYGNMLKSRIINTAVKSSPPPFLYIYLAYNIDRYDGLFYCDQNQDQLGKVPWLVIKSNQYFVPSLFLVPSFKQELSKLFPDEETVFHHLGRYLFQPSNEAWGLITRFYRAYLSKADETIGIQVRVFDTKATPFKTVMDQILSCTLKEKLLPEVLDVQNSAASLSNNQGLKAVLVTSLYSEYYEHIKGMYWTKPTVSGEVIGVYQPSHEEHEIYGNNMHSMKAWTEIYLLSMSNVLITSSWSTFGYVAQSLGGLKPWMLYRPLNGTTPDPPCVQAMSMEPCFHFPPSYGCKADVYIGPGAIVPHVKHCEDVEWGLKLVKDH

SEQ ID NO: 315 - DNA, 1659 bp, Sorghum bicolor
  misc_feature 1..1659: note = Ceres Annot ID no. 8735776
  misc_feature 1..1659: note = Encodes the peptide sequence at SEQ ID NO. 316
  source 1..1659: mol_type = other DNA
atgtccataaatcaagggtattttgccatacaacccagcggaagtgcattagtaaaaacttatagaatcagtacccaaaaaaatcagtcaatagagattaattgtctaattctgcattctgtcaataaagagattttgggttgtggtcacaacttaactctggttttttggcttacactggtagaatccaagaaagacgcacttcttggtggcctgctgcttccagggttcgacgagcagacctgcgccagccgctatcagtccgtttactaccgcaagaacatgacccggctgccgtccccgtacctcatcaagcggctgcgggagcaggaggcgctgcagcggcggtgcggcccgggcacggagccatacatgagagcgtcggagaggctccggtccgggcaaaccggcgccgccgtcgacgacgtcgacggctgcagctacctcgtgctcatctcctacaggggcctcggcaaccggatgctcgccatcacctcggtgttcctctacgccctgctcaccaaccgcgtcctcctcgtggaccgcggctacggcaacaccctgccggacctcttctgcgagccgttcccggggacgacatgggcgctgccgcaagacttcccgctcgacggccagttccggcagctggacgagtcggcgccggagagctacgggaacgtggtggtgaaccggagcgggtccgtgtccgggttgcggttcgtgtacctgcacctcgaccacgccgcgtcgccggcgaaccggctcgtgtactgcgacgaccaccgccgcgagtcgttcctccgccggatgcagtgggcgatcatccggacggaccagtacatggcgccggggctcttcttcaacctggcgtaccaggaggagctggaccggctgttcccgcggaaggacacggtgttctacctcctgtcgcggtacctgctgcacccgaccaacgacgtctggggcatggtcaccaggttctacaactcgtacctgagggacgccgacgagcggctgggcatccagatccgggtgctgtccggcgaccatcgcgacaaggcgcagaacgtcctggaccagatcctggcgtgcgcgtcgcgggagcatctgctgccgggggtggtcaccacggatggggtcgcgccggcgccgccgcacgccggagcgcggcggcggtccaagaagaaggccgttctggtcaccgggctgagcgcgtggtaccacgacaacatcaaggagatgtactggaagtcggcgaccgtcgacggcgaggtggtgagcctgttccagcccagccacgaggagcaccagcagtggtaccacaacaagcacgacatgaaggcggcggcggagatctacctgctcagcctgaccgacaagatcgtcaccagcgcgtggtcgacgttcgggtacgtcggctacgcgatgggcgggctcaggccgtacctcatgttcatgccggagaaccagacggcgccggacccgccatgcacgagggccatgtccatggagccgtgctctcacggggcgccctccttcgagtgcacgaggaaagagatcggcaccatcatcaacaccgggatcctgctgccccatgtccgtgcttgcgaagacatctcatgggggctcaaacttactgacccggacgtagaaaattag

SEQ ID NO: 316 - protein, 552 aa, Sorghum bicolor
  REGION 1..552: note = Ceres Annot ID no. 8735776
  REGION 36..517: note = Pfam Name: XG_FTase Pfam Description: Xyloglucan fucosyltransferase
  REGION 1..552: note = Bit score of 774.4 for HMM based on sequences of Figure 10
  REGION 1..552: note = Functional Homolog Of SEQ ID NO. 280
MSINQGYFAIQPSGSALVKTYRISTQKNQSIEINCLILHSVNKEILGCGHNLTLVFWLTLVESKKDALLGGLLLPGFDEQTCASRYQSVYYRKNMTRLPSPYLIKRLREQEALQRRCGPGTEPYMRASERLRSGQTGAAVDDVDGCSYLVLISYRGLGNRMLAITSVFLYALLTNRVLLVDRGYGNTLPDLFCEPFPGTTWALPQDFPLDGQFRQLDESAPESYGNVVVNRSGSVSGLRFVYLHLDHAASPANRLVYCDDHRRESFLRRMQWAIIRTDQYMAPGLFFNLAYQEELDRLFPRKDTVFYLLSRYLLHPTNDVWGMVTRFYNSYLRDADERLGIQIRVLSGDHRDKAQNVLDQILACASREHLLPGVVTTDGVAPAPPHAGARRRSKKKAVLVTGLSAWYHDNIKEMYWKSATVDGEVVSLFQPSHEEHQQWYHNKHDMKAAAEIYLLSLTDKIVTSAWSTFGYVGYAMGGLRPYLMFMPENQTAPDPPCTRAMSMEPCSHGAPSFECTRKEIGTIINTGILLPHVRACEDISWGLKLTDPDVEN

SEQ ID NO: 317 - protein, 565 aa, Oryza sativa
  REGION 1..565: note = Public GI ID no. 125554515
  REGION 60..532: note = Pfam Name: XG_FTase Pfam Description: Xyloglucan fucosyltransferase
  REGION 1..565: note = Bit score of 838.9 for HMM based on sequences of Figure 10
  REGION 1..565: note = Functional Homolog Of SEQ ID NO. 280
  source 1..565: note = Oryza sativa subsp. indica
MERESSTPASSWLGIDEAAPFAGKKATKDAAAADAFVRRWPKVVNATLVAFIMTMPPLLILLGGGRPGAPAVWIKSTVASLAARGEPKKDVLLGGLLLPGFDEQSCVSRYQSVYYRKNMTRPPSPHLLRRLRQQEALQRRCGPGTEPYRRASERLRSGQNAGDDFVATVDGCGYLVLISYRGLGNRILSITSAFLYAMLTGRVLLLDPGKTMADLFCEPFQATSWMLPGDFPLEHFRDLGEDAPESYGNVAVNRSGSVAGLRFVYAHLDHAATPANRLLYCDDHRQFLHRVQWVILRTDSYIVPGIFLNPAYKEELDMMFPNKDAVFYLLSRYLLHPTNDVWGMVTRFYHSYLKNADERLGVQIRVFDGDEPFQHILDQILACTSQEHLLPGVVVSGHGGGVAPPPIARSKAVLTTGLNSWYHDSIRDMYWRSPSATGEVVSVHQPSHELHQHFFRSTHDMKALAEMYLLSLTDKIVTSGWSTFGYVGAGLGGLTPYIMIKPENHTVPNPPCVRAMSMEPCDHGPPYFECTKKEIDKIIDTGNLVPHVRSCEDVPWGRKLADPIS

SEQ ID NO: 318 - protein, 568 aa, Populus X canescens
  REGION 1..568: note = Public GI ID no. 154163097
  REGION 57..539: note = Pfam Name: XG_FTase Pfam Description: Xyloglucan fucosyltransferase
  REGION 1..568: note = Bit score of 938.0 for HMM based on sequences of Figure 10
  REGION 1..568: note = Functional Homolog Of SEQ ID NO. 280
MSDMVSNEFSGMISTIRDQTSCNRKGFQFKVQRNGYCSVIPFACLTVLFSILVTVLIVQQRSTTFKVNGGDAKINALAGGAAQTETPGFVGSGNASSQQLLDELFAPGHDKGSCLSRYEAILYRKPSSHKPSPYLLSKLRNYESLHNLCGPYTEAYNKTLEQLSTGREVSTTDCNYVVYTPLSGLGNRMLTIASAFLYALLTNRVLLVEFGSEIAGLFCEPFQQTTWLLPRDFPLRNQFDNFSQGYPRTYGNMLKSRVINTAVKSPPPPFLYIYLAYNIDRYDGLFYRDQNQDQLGKVPWLVIKSNQYFVPSLFLVPSFKQELSKLFPDEETVFHHLGRYLFQPSNEAWGLITRFYRAYLSKANETIGIQVRVFDPKATPFQTVMHQILSCTLKEKLLPEVLDVKNSAASSSNNQSMKAVLVTSLYSEYYEHIKGMYWTKPTVSGEVIGVYQPSHEEHEIYGNNMHSMKAWTDIYLLSMSNVLITSSWSTFGYVAQSLGGLKPWMLYRPFNGTTPDPPCVQAMSMEPCFHFPPSYGCKADVDIGPGAIVPHVKHCEDVEWGLKLVKDH

SEQ ID NO: 319 - DNA, 1713 bp, Sorghum bicolor
  misc_feature 1..1713: note = Ceres Annot ID no. 8673445
  misc_feature 1..1713: note = Encodes the peptide sequence at SEQ ID NO. 320
  source 1..1713: mol_type = other DNA
atgtcttccttggcggcggctgcggcacccgacctgcaggtggacgaggccgtaaggaggagatggtggccatggccgcgcagttgctcctccaacactactagaaggaaggccctgctggccatctgcgccggggcgaccgtcatcgtcgtgctattcgccggcgggagctcacccgacgggatgctgcactccttgctcttccaccacttacaaggttttgaagacagaccaccatttaacctcaccaccgaccatctcctcgacggccttctcacggctgagtacggctaccagtcgtgccggagccgatatgaattcgccggttaccacaagaaatcgtcgcatcagccatcaccctacctcctcgccaagctgcggaagcaagaagcactccaaaagcgatgcggccccggcacggccgcgtacaagaaggcactccggcggcttgaatccaacgctgccgacgtcgaggacgacgatgactgccggtacctcgtgaacatcagctttcgattccgaggcctcggcaaccggatgctcgccgtcgcgtcggccttcctctacgcggtgcttacagagcgcgtcctcctcatcaacgcagacaagggtgatgtgcccgatctcttctgcgagccctttccaggcgcgacgtggctgctgccgcgcgccggtcgccgctccccgctcacgaagctcgatgattaccagggggggtcgaaggagagcctggggaacatgctgcagagaggcgtcgccggcgtgtccgccgacgggaacatgtcgtggctgtctccaccgcagccgccgccatatgtgtacctccacctcgctggcgtgtacggcttccacgacaagcttttctactgcggggagcaccagcggctcctccgcggagtgccgtggctgttcatgagggcggacggctacctggtgcccgggctgttcctcacgccgccgttcgtcggagagctcgaggccatgttcccggagaaagacgccgtgttctaccacctgggtcgataccttttcctccccagcaacgccgtctggcgcgctgtcacgagctactacagcgccaacctcgcaggcgtcggccgcctcgtcggcatccagatcagggtgttccaggagaagaagccgccgcagcaaatcctggaccagatcctgtcctgcgtccgcgacgagaagctgctcccagagacgaccacaaaagacaacggcacgtcgtcgccctacggtgtccttgtgacgtcgctgagctcgtggtactacgagaggctcaagggcgagtacggcggtagactcgccggcggcgtgcaccagccgagccacgaggggcggcagcggttgcgcaacgaagcgcacgacgtgaaggcgctgagcgagatgtacctgctcagcatgtgcgacgtgctcgtcaccagcggcttctccacgttcgggtacgtcgcgcagggcctcggcgggctgcagccgtgggtcatgtcgaggccgtccccgttcgaggagtggacggagggtcaggcggcgccagaaccgccatgccagcgcgcgctctccgtcgagccttgcttccactcaccatcgtcctatgactgcacggtgaggagagacgtggagctggacaaggtgacgccctacatcaggcgctgcgtggacgtcagctggggcataaagcttgtgaatcaaagccgcgacggtcagtggtag

SEQ ID NO: 320 - protein, 570 aa, Sorghum bicolor
  REGION 1..570: note = Ceres Annot ID no. 8673445
  REGION 53..536: note = Pfam Name: XG_FTase Pfam Description: Xyloglucan fucosyltransferase
  REGION 1..570: note = Bit score of 760.5 for HMM based on sequences of Figure 10
  REGION 1..570: note = Functional Homolog Of SEQ ID NO. 280
MSSLAAAAAPDLQVDEAVRRRWWPWPRSCSSNTTRRKALLAICAGATVIVVLFAGGSSPDGMLHSLLFHHLQGFEDRPPFNLTTDHLLDGLLTAEYGYQSCRSRYEFAGYHKKSSHQPSPYLLAKLRKQEALQKRCGPGTAAYKKALRRLESNAADVEDDDDCRYLVNISFRFRGLGNRMLAVASAFLYAVLTERVLLINADKGDVPDLFCEPFPGATWLLPRAGRRSPLTKLDDYQGGSKESLGNMLQRGVAGVSADGNMSWLSPPQPPPYVYLHLAGVYGFHDKLFYCGEHQRLLRGVPWLFMRADGYLVPGLFLTPPFVGELEAMFPEKDAVFYHLGRYLFLPSNAVWRAVTSYYSANLAGVGRLVGIQIRVFQEKKPPQQILDQILSCVRDEKLLPETTTKDNGTSSPYGVLVTSLSSWYYERLKGEYGGRLAGGVHQPSHEGRQRLRNEAHDVKALSEMYLLSMCDVLVTSGFSTFGYVAQGLGGLQPWVMSRPSPFEEWTEGQAAPEPPCQRALSVEPCFHSPSSYDCTVRRDVELDKVTPYIRRCVDVSWGIKLVNQSRDGQW

SEQ ID NO: 321 - protein, 601 aa, Oryza sativa
  REGION 1..601: note = Public GI ID no. 115445521
  REGION 76..566: note = Pfam Name: XG_FTase Pfam Description: Xyloglucan fucosyltransferase
  REGION 1..601: note = Bit score of 744.6 for HMM based on sequences of Figure 10
  REGION 1..601: note = Functional Homolog Of SEQ ID NO. 280
  source 1..601: note = Oryza sativa subsp. japonica
MGSAGGGGWDDDDDGDEQCATPPPPRSFSPMMMTEAGMKLVTPPWRRWRRWRGGCAESGRAVRAACVAAAVVLAVVVLSYYARWGGDQDEMPTSLFTTRGSEGATSANLTDDQLLGGLLTAAFSPQSCRSRYEFAGYHKRKPPHKPSPYLVAKLRSHEALQKRCGPGTAPYDKALRQLKSGDGAAAADGDDDCRYLVSISYNRGLGNRIIAIVSAFLYAVLTERALLVAPYNGDVAALFCEPFPGTTWLLPDGGRRFPLLHLRDLDGKSKESLGALLKSNGIVSVAAGVNGSTSSSWSGRPPPPYVYLHLDGGADYHDKLFYCDEQQRLLRGVPWLLMKTDSYLVPGLFLVPSLRGELERMFPEKDAVFHHLSRYLLHPANAVWHAITAYHRDHLAGAGHLVGIQIRVYHEETPPVSQVVLDQVLSCARRENLLPAAGNTSSSDQAVLVTSLSSWYYEKIRDELGGGGGGVHQPSHEGLQRMGDTAHDMRALSEMYLLSTCDALLTTGFSTFGYVAQGLAGLRPWIMPRRPWWEKEAATAVPDPPCARVATPEPCFHSPSYYECAARRNYDDIGKVVPYVRRCEDVSWGIQLVNGSSQSQW

SEQ ID NO: 322 - DNA, 1947 bp, Populus balsamifera
  misc_feature 1..1947: note = Ceres Annot ID no. 1448328
  misc_feature 1..1947: note = Encodes the peptide sequence at SEQ ID NO. 323
  source 1..1947: mol_type = other DNA
atggaaatctttaaagctgcaaaagaaagattgggatttaatttcaggaggtgcacgacaatcttggttttgtctttcattgttttggctgtgctagtgagggtctttgtctcgtatcaagactcggcatttgatctaattgggggtttagctaaagctaaggtttctccagcaaatactcaagatgttgcagcattaggttttgcctcaataaatgattcctctcaaccaactagcttgcctgatcagaaggtgcttaatgaacagctgccacccagatttggcaacggatcaatttcaaaaaatgagtcctctcagcctaccagcatacgtgatgacacactggttaatggacttttggctcctggatctggtgatggatcaagttcaaaaaacgattcctctcagcctactagcgagcctgatgataaacctctttcctctcagcctaccagcaagcctgatgataagctgcttggtcaaccattggctcctggatttgttgaagaattaggtttgaaaactgattcctcgcaacctaccaaaatggctaatgataaattgcttgacgggcttctatcccctgggtttgatgaaaaatcctgcttgagtagataccgttctttcctataccgcaaagcttctcaacataagccctctccctatctcctttccaagctacgcgagtatgaagatcttcataaacgttgcggaccatacaccagatcttacaatgaaacattaaagagactcaaatctagccatacaggtagtactggtgggtgtaattacattgtctggttgggttctaacgggatggggaacaggataataagcatggcttcaacatttctttatgctctccttgcaaatcgagtcctacttgttgatcatggcagggacatgactcacctcttttgcgagccatttcccaacacgtcatggatattgcccatggacttccccattaaaaaacaattccataccttgaaacagagacatgatcgattcagagatatatcagagtcgtcgcccccatcatttgtatatgttaatatacctcacggtacttatgattttgatgagcttttcctgtgtgagcagagcagagctctcctcgaaagagttccttggtttattctatcgtctgaccaatattttgccccatctttcttcctgagcccatctttcaagcaagaggtaagcaagctgttcccagaaaaagaaaccattttccatcaattgggtcgctatcttttccacccctccaatcaggtttggagagtaattacaaagttctatcagactaatctagcgaaggcagaacagagaattggcctccaaataagagtatttaaccgcaagactagtccagttcaagtggtcatgggtcagatattatcctgtatgctgaagaaaaagcttcttccagaagttgatacccagaacgctgtacgttcttctcctccaaataattcttctaaaactattttaataacttccttgtattcagactactatgagaacatgagtgccatgtaccagtcaaaaccaactgtgacaggtgaagcgatcagggtttgccagccaagccacgaagaatatcaacacaaagcggataacctgcacaacatgaaggcgtgggcagaaatttatctgctgagcttgagtgatgttctagtcaccagtgccgggtcaacctttggctatgctgcacaaggtctaggaggtttgaagccatggatgttgattagaccaaagaataaaatggttccagatccgccttgtcgacaagacaaatccatggacccttgtttccactatgctcccagttatgaatgcaaggcgaagcacaaaactgattcttccactgttgttccttatgtaaggcattgtgcagatcggcaggcaggagtgaagctttttaatgatcataaacgattgtag

SEQ ID NO: 323 - protein, 648 aa, Populus trichocarpa
  REGION 1..648: note = Ceres Annot ID no. 1448328
  REGION 146..616: note = Pfam Name: XG_FTase Pfam Description: Xyloglucan fucosyltransferase
  REGION 1..648: note = Bit score of 835.4 for HMM based on sequences of Figure 10
  REGION 1..648: note = Functional Homolog Of SEQ ID NO. 280
MEIFKAAKERLGFNFRRCTTILVLSFIVLAVLVRVFVSYQDSAFDLIGGLAKAKVSPANTQDVAALGFASINDSSQPTSLPDQKVLNEQLPPRFGNGSISKNESSQPTSIRDDTLVNGLLAPGSGDGSSSKNDSSQPTSEPDDKPLSSQPTSKPDDKLLGQPLAPGFVEELGLKTDSSQPTKMANDKLLDGLLSPGFDEKSCLSRYRSFLYRKASQHKPSPYLLSKLREYEDLHKRCGPYTRSYNETLKRLKSSHTGSTGGCNYIVWLGSNGMGNRIISMASTFLYALLANRVLLVDHGRDMTHLFCEPFPNTSWILPMDFPIKKQFHTLKQRHDRFRDISESSPPSFVYVNIPHGTYDFDELFLCEQSRALLERVPWFILSSDQYFAPSFFLSPSFKQEVSKLFPEKETIFHQLGRYLFHPSNQVWRVITKFYQTNLAKAEQRIGLQIRVFNRKTSPVQVVMGQILSCMLKKKLLPEVDTQNAVRSSPPNNSSKTILITSLYSDYYENMSAMYQSKPTVTGEAIRVCQPSHEEYQHKADNLHNMKAWAEIYLLSLSDVLVTSAGSTFGYAAQGLGGLKPWMLIRPKNKMVPDPPCRQDKSMDPCFHYAPSYECKAKHKTDSSTVVPYVRHCADRQAGVKLFNDHKRL

SEQ ID NO: 324 - DNA, 1602 bp, Populus balsamifera
  misc_feature 1..1602: note = Ceres Annot ID no. 1437779
  misc_feature 1..1602: note = Encodes the peptide sequence at SEQ ID NO. 325
  source 1..1602: mol_type = other DNA
atggtggtttcatttttgatagctttctttctgctatacatgctctccatggcttacagaagctcaacttttgatctaattggggaatttgccaaagctcatgtcactggagaaatggctggaaatgttagtagagcctcagagtcggaagacaaacattcatctcaccctgaaagggtggttgttgataaattgcttggtggacttctggctccaggatttgatgaagaatcatgcataagcaggtaccaatcgagcttgtgtcgcagagtttcacctcataagccctcttcctatcttgcatcgaagctgcgtaaatacgaagagcttcataagcgctgcggacctcacactgaatcctacaatagaaccctgaaagaattgagttctagccatatcaatggtactacagactgcaattacgttgtttggacgcctgctaatggcttggggaataggattattagcatggcttcatcatttctgtatgctgtcctcactaacagagtcctacttgtcgatcatggaactgacatggctaatatcttctgtgagccgtttccaaatacatcatggttactgcccatggatttccctctcagtaatcaattctacggcttgcaatcaggaaatgttcatagttatgggcagctgctaaagaataacaacatgaacatctcaactgtgtcgcagccaccgccatttctttatctatatctatcttacaactatgatgaatacgagaagcttttttaccaggatcaaaaccagggttttctccaaaacgtcccttggttgattctgaagtcagaccaatactttgcgccttacctcttcttgatcccatctttccagcaagaactagacaaattatttcctgataaggagactgtttttcaccacttggttcgctatcttttccatccttcaaatcaagcctggggactaatcaccagattctatcagtcttacctggccagtgcagagcagagaattggtcttcaagtaagagtattcaatagaaaagcgagtccaattaaagttgttctggagcagatactaggctgcgttcaaaaagaaaagctgctgcctcaagtagacgaggaaaaacatatagctcctccatcaaaaaacaagacctcaagagctattaccatagcatcattatatccagaatactacgaaagcataaagaacgtgtattggatgagaccaactgtaaatggtgatgttattggggtttaccagccaagtcatgaagaggctcaacaatttgggaacaacatccacaacatcaaggcatgggctgaaataaacatcctaagtttgagtgatgttttggtgactagttcttggtctacttttggctatgtagctcaaggtctaggaggattgaaaccatggattctatatgttcctaccggtggccaaacgaatgaccagccgtgtccacgagccatgtctatggagccatgttttcattttcctcctaattattaccaaaatgcaggtaccagacggagacttgacactgtttccccagttcctcatatcaggcagtgtgaggatgcaagcacgggaataaagcttgttaatgattaa

SEQ ID NO: 325 - protein, 533 aa, Populus trichocarpa
  REGION 1..533: note = Ceres Annot ID no. 1437779
  REGION 22..503: note = Pfam Name: XG_FTase Pfam Description: Xyloglucan fucosyltransferase
  REGION 1..533: note = Bit score of 880.9 for HMM based on sequences of Figure 10
  REGION 1..533: note = Functional Homolog Of SEQ ID NO. 280
MVVSFLIAFFLLYMLSMAYRSSTFDLIGEFAKAHVTGEMAGNVSRASESEDKHSSHPERVVVDKLLGGLLAPGFDEESCISRYQSSLCRRVSPHKPSSYLASKLRKYEELHKRCGPHTESYNRTLKELSSSHINGTTDCNYVVWTPANGLGNRIISMASSFLYAVLTNRVLLVDHGTDMANIFCEPFPNTSWLLPMDFPLSNQFYGLQSGNVHSYGQLLKNNNMNISTVSQPPPFLYLYLSYNYDEYEKLFYQDQNQGFLQNVPWLILKSDQYFAPYLFLIPSFQQELDKLFPDKETVFHHLVRYLFHPSNQAWGLITRFYQSYLASAEQRIGLQVRVFNRKASPIKVVLEQILGCVQKEKLLPQVDEEKHIAPPSKNKTSRAITIASLYPEYYESIKNVYWMRPTVNGDVIGVYQPSHEEAQQFGNNIHNIKAWAEINILSLSDVLVTSSWSTFGYVAQGLGGLKPWILYVPTGGQTNDQPCPRAMSMEPCFHFPPNYYQNAGTRRRLDTVSPVPHIRQCEDASTGIKLVND

SEQ ID NO: 326 - protein, 503 aa, Arabidopsis thaliana
  REGION 1..503: note = Public GI ID no. 15226507
  REGION 1..474: note = Pfam Name: XG_FTase Pfam Description: Xyloglucan fucosyltransferase
  REGION 1..503: note = Bit score of 793.7 for HMM based on sequences of Figure 10
  REGION 1..503: note = Functional Homolog Of SEQ ID NO. 280
MFCHSLLAQRILLLTFFFVICSDESETPGRDRLIGGLLTADFDEGSCLSRYHKTFLYRKPSPYKPSEYLVSKLRSYEMLHKRCGPGTKAYKEATKHLSHDENYNASKSDGECRYVVWLADYGLGNRLLTLASVFLYALLTDRIILVDNRKDIGDLLCEPFPGTSWLLPLDFPLMKYADGYHKGYSRCYGTMLENHSINSTSFPPHLYMHNLHDSRDSDKMFFCQKDQSLIDKVPWLIFRANVYFVPSLWFNPTFQTELTKLFPQKETVFHHLGRYLFHPKNQVWDIVTKYYHDHLSKADERLGIQIRVFRDQGGYYQHVMDQVISCTQREKLLPELATQEESKVNISNIPKSKAVLVTSLSPEYSKKLENMFSERANMTGEIIKVYQPSGERYQQTDKKVHDQKALAEMYLLSLTDNIVASSRSTFGYVAYSLGGLKPWLLYLPNDNKAPDPPCVRSTSMEPCFLTPPTHGCEPDAWGTESGKVVPFVRYCEDIWGLKLFDEL

SEQ ID NO: 327 - protein, 539 aa, Populus X canescens
  REGION 1..539: note = Public GI ID no. 154163099
  REGION 23..506: note = Pfam Name: XG_FTase Pfam Description: Xyloglucan fucosyltransferase
  REGION 1..539: note = Bit score of 887.4 for HMM based on sequences of Figure 10
  REGION 1..539: note = Functional Homolog Of SEQ ID NO. 280
MDIFQMERPGYGSKRFPKLVVSFLVAFCLLYMASMVYRSSTFVLIGEAAKDNGAGEVAENVTTPSGTLLGGLLATGFDEESCISRYQATSYRKTSPHKPSAYLVSKLRKYEDLHKRCGPNTESYKRALKNLSSSHINGTTGCNYIVWTPSNGLGNRIISMASSFLFAILTNRVLLVDHGTDMAGIFCEPFPNTSWLLPMDFPLTNQFYSLQPGNAHSYGHLLKINNMNISAVSQPPSFLHIYLAYNYDKHDKLFFQDQNQGFLRKVPWLILKSDQYFVPYLFLIPSFQQELGKLFPDKGTVFHHLVRYLFHPSNQAWGLITRFYRAYLASADQKIGLQVRVFDRKASPVNVVLEQILGCIQKEKLLPQVDEQKPIASPSKNQTLRAVTIASLYPEYYERIKSMYWMKPAVNGDVISVYQPSHEEVQHFGNNIHNMKAWAEISILSLSDVLVTSSWSTFGYVAQGLGGLKPWILYVPAGNHPTDQPCPRGMSMEPCFHFPPDYYRISNTRQRLDSGSLVTHVRQCEDASRGIKLFNAKQL

SEQ ID NO: 328 - protein, 514 aa, Arabidopsis thaliana
  REGION 1..514: note = Public GI ID no. 93139696
  REGION 14..484: note = Pfam Name: XG_FTase Pfam Description: Xyloglucan fucosyltransferase
  REGION 1..514: note = Bit score of 791.3 for HMM based on sequences of Figure 10
  REGION 1..514: note = Functional Homolog Of SEQ ID NO. 280
MKILIAVVFGCLLIILSFSKYFNDQLLDATTKDIKESERPVDKLIGGLLTADFDEGSCLSRYHKYFLYRKPSPYMPSEYLVSELRSYEMLHKRCGPDTKAYKEATEKLSRDEYYASESNGECRYIVWLARDGLGNRLITLASVFLYAILTERIILVDNRKDVSDLLCEPFPGTSWLLPLDFPMLNYTYAYGYNKEYPRCYGTMLENHAINSTSIPPHLYLHNIHDSRDSDKLFFCQKDQSFIDKVPWLIIQTNAYFVPSLWLNPTFQTKLVKLFPQKETVFHHLARYLFHPTNEVWDMVTKYYDAHLSNADERLGIQIRVFGKPSGYFKHVMDQVVACTQREKLLPEFEEESKVNISKPPKLKVVLVASLYPEYSVNLTNMFLARPSSTGEIIEVYQPSAERVQQTDKKSHDQKALAEMYLLSLTDNIVTSGWSTFGYVSYSLGGLKPWLLYQPVNFTTPNPPCVRSKSMEPCYHTPPSHGCEADWGTNSGKILPFVRHCEDMMYGGLKLYDDF

SEQ ID NO: 329 - protein, 619 aa, Populus X canescens
  REGION 1..619: note = Public GI ID no. 154163101
  REGION 117..587: note = Pfam Name: XG_FTase Pfam Description: Xyloglucan fucosyltransferase
  REGION 1..619: note = Bit score of 807.5 for HMM based on sequences of Figure 10
  REGION 1..619: note = Functional Homolog Of SEQ ID NO. 280
MLSSLSWFLHLLISCLFIPSLFSLFTASINDSSHPTSLPDQKVLNEQPPPRFGNGSISKNGSSQPTSIPDDTLVNGLLAPGSGDGSSSKNDSSQPTSEPDDKPLSSQPTSEPDNKPLSSQPTSEPDEKLLGQPLAPGFVEELGLKSDSLQPTKMANDKLLDGLLSPGFDEKSCLSRYRSFLYRKASQHKPSPYLLSKLREYEDLHKRCGPYTRSYNETLKRLKSSHTGSTGGCNYIVWLGSNGMGNRIISMASAFLYALLANRVLLVDHGRDMAHLFCEPFPNTSWILPMDFPIKKQFHTLKQRHDRFRDISESSPPSFVYVNIPHGTYDFDELFLCDQSRALLEKVPWFILSSDQYFAPSFFLSPSFKQEVSKLFPEKETIFHQLGRYLLHPSNQVWRVITKFYQTNLAKAEQRIGLQIRVFNRKTSPVQVVMDQILSCMLKKKLLPEVDTQNDVRSSPPNNSSKTILITSLYSDYYENMSAMYQSKPTVTGEVIRVCQPSHEEYQHEADNLHNMKAWAEIYLLSLSDVLVTSAGSTFGYAAQGLGGLKPWMLIRPKNKMVPYPPCRLDKSMDPCFHYAPSYECKAKHKTDFFTVAPYVRHCADRQAGVKLFNDHKRL

SEQ ID NO: 330 - DNA, 2088 bp, Populus balsamifera
  misc_feature 1..2088: note = Ceres Annot ID no. 1448327
  misc_feature 1..2088: note = Encodes the peptide sequence at SEQ ID NO. 331
  source 1..2088: mol_type = other DNA
atggaaatctttgaagtagtgaaggataaattggggtttgattccaagagatactcaacattattacttgtgtgtgccattgctttgcctgtgtctttcatgatattgattatgtatcagaacccatcattcgatctaagtggaggattagccaaggctgagaaatctggaaatgtcccaataatcaatgctgattttaaaaatgattcttcaccacctgccttcatccctgatggaagactgcgtaagaggcatttgcctcctggatttggcaatggaactagttcaaaaaacaattccttgccgcatgccaacgagactggtgagaagaagcagcttaacagaactttgtctccaggatttcggaaagaatcaggctcgagaaatgattccttcggcaatggaactagttcaaaaaataattccttgccgcataccagcgggcctaatgagaaggagcttaacagaactttggctccaggatttcggaaagaatcaagctcaagaaaagattcctttggaaatggcgcaagttcaaaatataattcctcgccgaatgccggcaggcctgacgagaagcaggataatggaacttcggcacctgaatttctgaaagaatcagattcaagaaacgattcctctcagagtaccagaatgcctgatgataaattgcttgatggacttctggctcctggatttgatgaaaggtcttgcttaagtaggtaccggtcttccctatttcgcaaaacttcaccccataagccctcttcctatctgctttcaaaactacgtaggtacgaagatctccataaacgttgtggacctcataccaaaccctacaacaaagcctttaagagactcaaatatagccatggcagtagtggaggatgtaactaccttgtatggatacctgttaatggtctgggaaacaggatgataagcttggcttccacatttctttatgccctcctcacagatcgagtcctacttgttgaacttggaaatgacatgtctgatctattttgcgagccatttccaaattcatcatggatgctgcccaagaacttcccccgtggggttgagtttcgcagtcctgacaagagacatgctcgtggctatggaaaccagttaaagaatggcattataaacgagtcgatggaatcgctgccgtcttatacattcctgaatctagatcattctcattatgatctggatagactaagtttttattgcaatcaaaatccaactcttctccgaaaggtaccttggttgtttctgatatcagatcaatattttgccccctctttcttcttgacgccaactttcaaaaaagaagtacagagaatgttgcctgagaaagaaactgttttccatcacttgggtcgctatcttttccatccttcaaatgaggcatgggggctaatcatcaggttctaccaggcatacctagccaaagcagatgagaggattggcctccaaattagagtattcaacaccaaaacaactacagttcaaactgttcttgatgaactgttaaaatgcacacagaaggaaaaattgttgccacaagtggatccacaaagtcctgtagctactccatccaaaaaccaaagatcgaaagctattctagtaacatctctatatacggagttcttcgaaaacataagtagcacatactgggctaaaccaactgtgacaggtgaagccataggggtttaccagccaagccacgaagaaattcaacactttggggataacatgcacaacatgaaggcatgggctgaaatgtatctgctaagtttgagtgacgtgctggtgacaagtgcttggtctacttttggatatgtggcccaaggtctagggggtctgaaaccatgggtcctgtacaagatagagcaaggaaacacccgaaatccatcttgtgtaagagacttatccatggagccttgttttcattttcctccaacttatgactgcagaacaaagaccaagatgaatgccggttctctctttccttatttgaaatattgcgaggatctggattggggagtcaagctagttggtgatcatcaggagttgcagctatag

SEQ ID NO: 331 - protein, 695 aa, Populus trichocarpa
  REGION 1..695: note = Ceres Annot ID no. 1448327
  REGION 187..661: note = Pfam Name: XG_FTase Pfam Description: Xyloglucan fucosyltransferase
  REGION 1..695: note = Bit score of 879.3 for HMM based on sequences of Figure 10
  REGION 1..695: note = Functional Homolog Of SEQ ID NO. 280
MEIFEVVKDKLGFDSKRYSTLLLVCAIALPVSFMILIMYQNPSFDLSGGLAKAEKSGNVPIINADFKNDSSPPAFIPDGRLRKRHLPPGFGNGTSSKNNSLPHANETGEKKQLNRTLSPGFRKESGSRNDSFGNGTSSKNNSLPHTSGPNEKELNRTLAPGFRKESSSRKDSFGNGASSKYNSSPNAGRPDEKQDNGTSAPEFLKESDSRNDSSQSTRMPDDKLLDGLLAPGFDERSCLSRYRSSLFRKTSPHKPSSYLLSKLRRYEDLHKRCGPHTKPYNKAFKRLKYSHGSSGGCNYLVWIPVNGLGNRMISLASTFLYALLTDRVLLVELGNDMSDLFCEPFPNSSWMLPKNFPRGVEFRSPDKRHARGYGNQLKNGIINESMESLPSYTFLNLDHSHYDLDRLSFYCNQNPTLLRKVPWLFLISDQYFAPSFFLTPTFKKEVQRMLPEKETVFHHLGRYLFHPSNEAWGLIIRFYQAYLAKADERIGLQIRVFNTKTTTVQTVLDELLKCTQKEKLLPQVDPQSPVATPSKNQRSKAILVTSLYTEFFENISSTYWAKPTVTGEAIGVYQPSHEEIQHFGDNMHNMKAWAEMYLLSLSDVLVTSAWSTFGYVAQGLGGLKPWVLYKIEQGNTRNPSCVRDLSMEPCFHFPPTYDCRTKTKMNAGSLFPYLKYCEDLDWGVKLVGDHQELQL

SEQ ID NO: 332 - DNA, 1782 bp, Sorghum bicolor
  misc_feature 1..1782: note = Ceres Annot ID no. 8681687
  misc_feature 1..1782: note = Encodes the peptide sequence at SEQ ID NO. 333
  source 1..1782: mol_type = other DNA
atggaggcggcgagggcgcgaacgccgcggggagcgcacaaggtggcgagcggcggcggagacctcggcgccgcgtggaatggtggcggaagctacaaggcgtggcggtggcaaggatggcgcgcgccggccccggcggtcgtcgggtgcttggccaccttgaccttgctcgtgctggtgctcggcggcggcggtcgtggaatcctatccacgttctcgccgctggaaactactgagttcgtgcagaagccagtttccgcagcgtcacgcgtccatgctgatgcagaggctgcaggattgaacgccaagcccgcgccgcctactcggcacgaccaagaccgcctcatcggcgggctcctctcccccgccttcgacgagcagtcgtgccgttcccggtacgcgtcgcctcactaccgccgtccgtctccgttccgcccatccacctacctcgtggagcgcctcaggcggtacgaggcccggcacaggcggtgcggacccaacgggcctctcttcaaggaagccgtccaacacctacggtccggccgtaacgccgcgcgctccgagtgccagtacgtcgtctggacgccgttcaacggcgtgggcaaccgcatgctctcgctcggctccacgttcctgtacgcgctcctcaccaaccgtgtcctgctcgtgcacgcgccgcaggaattcgacggcctcttctgcgagcctttccccggcagctcctggacgatccccgtcgacttcccgatcaccgacttcgccggcagtttcaccatgtggtcgccgacgagctacaagaacatgcgccaggcgggttccgtaagcggtgaccaccgcaatgtctccgccgacaggctaccggcgtacgtgtttctggacctcatccagtcgttcaccgacgccgccttctgcgaggccgaccagctcgtgctcgccaagttcaactggatggtgatcaagtcggacgtgtacttcgcggccatgttctttctcatgccggcctacgagcgcgagctccggcggctgttcccggagaaggaggccgcgttccaccacctcgcccggtacctcttccacccgtccaacgacgtgtggggcatcgtgcgcaggtactacgaggcctaccttgccagggccgacgagcgcgtcggcctccaggtgcgcgtcttcccggagatgcccgtgccgttcgacaacatgtacggccagattgtccggtgctcggagcaggagggcttgctgccgaaggttgtgcgaaaggacagtgacggcgaggcgaaccactcctcgccggcggccgtggcgccggagagtagtaggacgaagctcacctcggtactggtgacgtcgctcttctccgactactacgagcgcatccaaggcgtgtactacgcgaacccgacggagaccggggagtacgtggaggtgcaccaaccgagccacgagggggagcaacgcacggaggcgcgtgcacacaaccagagggccctggcggagatgtatctgctgagcttctgcgatcgcatcgtgacgagcgcggtgtcgacgttcgggtacatcgcgcacgggctcgccggcgtgcgaccctgggtgctgctccggccgccgtcccccgaaacacatgctgatccagcgtgcgttcaatcgaagacagtcgagccctgtcttcaggcgccgccgcgacaaatttgcggagcagcagaggggactgacattggagctctagtgccttatgcccggcactgtgaggacgagcacaagggtctcaagttgttcccttag

SEQ ID NO: 333 - protein, 593 aa, Sorghum bicolor
  REGION 1..593: note = Ceres Annot ID no. 8681687
  REGION 72..566: note = Pfam Name: XG_FTase Pfam Description: Xyloglucan fucosyltransferase
  REGION 1..593: note = Bit score of 703.3 for HMM based on sequences of Figure 10
  REGION 1..593: note = Functional Homolog Of SEQ ID NO. 280
MEAARARTPRGAHKVASGGGDLGAAWNGGGSYKAWRWQGWRAPAPAVVGCLATLTLLVLVLGGGGRGILSTFSPLETTEFVQKPVSAASRVHADAEAAGLNAKPAPPTRHDQDRLIGGLLSPAFDEQSCRSRYASPHYRRPSPFRPSTYLVERLRRYEARHRRCGPNGPLFKEAVQHLRSGRNAARSECQYVVWTPFNGVGNRMLSLGSTFLYALLTNRVLLVHAPQEFDGLFCEPFPGSSWTIPVDFPITDFAGSFTMWSPTSYKNMRQAGSVSGDHRNVSADRLPAYVFLDLIQSFTDAAFCEADQLVLAKFNWMVIKSDVYFAAMFFLMPAYERELRRLFPEKEAAFHHLARYLFHPSNDVWGIVRRYYEAYLARADERVGLQVRVFPEMPVPFDNMYGQIVRCSEQEGLLPKVVRKDSDGEANHSSPAAVAPESSRTKLTSVLVTSLFSDYYERIQGVYYANPTETGEYVEVHQPSHEGEQRTEARAHNQRALAEMYLLSFCDRIVTSAVSTFGYIAHGLAGVRPWVLLRPPSPETHADPACVQSKTVEPCLQAPPRQICGAAEGTDIGALVPYARHCEDEHKGLKLFP

SEQ ID NO: 334 - DNA, 2022 bp, Populus balsamifera
  misc_feature 1..2022: note = Ceres Annot ID no. 1437782
  misc_feature 1..2022: note = Encodes the peptide sequence at SEQ ID NO. 335
  source 1..2022: mol_type = other DNA
atggaaatttttgaagtagcgaaggataaattagggcttggttccaagagatacacaacattgttatttgcgtgttccgttgctttgcctgtgtctctcatgatcttgattgtgtatcagaatcagctgtttcatctaactggagggttagctcaagctgaaaaatctcgaaatgttacagcattgaatgttgattcgaaaaatgattcttcacctcctgccatcattcctgatggaagactgcataacgggaatttgcctcctggatttggcaatggaactagttcagaaaataattccttgcggcatactagcgggactgataagcagcttaatggaaccatggctccaggattttggatagaatcaggttcaaggaatggttccttcggcaatgaaactagttcaaaaaataattccttgccgcatgccagcgggcctgatgagaagcagcttaatggaactttggctccaggattccggaaagaatcaggttcaagaaattattcagaaaatgattccttgctgaataccagcaggcctaatgtcaagcagcttaatgaaactttggatccaggatttcggaaagaatcaggttcaagaaatgattcctctcagggtaacagaatgcctgatgataataaattgctcgatggacttctggctcctggatttgatgaaagatcttgcgcaagtaggtatcagtctttcctatttcgcaaaacttcactccataagccctcttcctatctcctttcaaaactacgtaggtacgaagatatccataaacgttgtggacctcattccaaatcataccacaaagcccttaaaagactcaaatctagccatggtagcagtggaggatgtaaatacattgtctggattcctgctaatggcttaggaaacaggatgctaagcatggctgcgacatttctttatgctctccttacaaaccgagtcctacttgttaatcataaaactgatatggccaatctcttttgcgagccatttctaaatacatcatggctgttacccgaggactttcccctcaggaatcattttggcaggtctaaacatggatatgcccacagctttggcagcatgctaaacaaaagtattaccaacgcttcaatggagccaccagaaccatatcttgatcttaatctagctctcggtggttatgatcaattagctttctgtgatgaaaaccaagctcttctccaaaaaattccttggttgatacttctatcagatcaatattttgtcccttctttattcatgatcccatctttcaatcgagagataagcaaattgttcccagaaaaggaaactgtgttctaccatttaggccactatcttttccacccctcaaatcaggtatggggactgatcactaggttttaccaggcttatctagccaaggcagatgagaggattgggctccaaataagagtatatcatgataagacaactccttttcaaactgttatggatcaaattttagattgtgtcttgaaggaaaaactcctgccagaagtagcagatacacaagaacctgcccctcctccatcaagaaatcagacttcaaaagctattctaataacatccttgtattccgagtactatgagaacatgaaaaacatgtattggacaagaccaactgtgacaggtgaagtcattagtgtttaccaaccaagccacgaggagtaccaacattttggagataatacgcacaacatgaaggcatgggcggatatatatctacttagtttgtgtgatgtactggtgacaagcacttcgtctacttttggctatgttgctcatggtttagcaggtttgaagccatggatttggcggatggggaataaaaatccagcttgtcagcgagccatatcaatggagccatgttgtcattttcctttgagttatgattgtaagacgaggattgaagtcaatgctgctactcttgttcctaatacaatgcattgcgaggatcgaaagaacggattaaagctggtttga

SEQ ID NO: 335 - protein, 673 aa, Populus trichocarpa
  REGION 1..673: note = Ceres Annot ID no. 1437782
  REGION 174..647: note = Pfam Name: XG_FTase Pfam Description: Xyloglucan fucosyltransferase
  REGION 1..673: note = Bit score of 816.9 for HMM based on sequences of Figure 10
  REGION 1..673: note = Functional Homolog Of SEQ ID NO. 280
MEIFEVAKDKLGLGSKRYTTLLFACSVALPVSLMILIVYQNQLFHLTGGLAQAEKSRNVTALNVDSKNDSSPPAIIPDGRLHNGNLPPGFGNGTSSENNSLRHTSGTDKQLNGTMAPGFWIESGSRNGSFGNETSSKNNSLPHASGPDEKQLNGTLAPGFRKESGSRNYSENDSLLNTSRPNVKQLNETLDPGFRKESGSRNDSSQGNRMPDDNKLLDGLLAPGFDERSCASRYQSFLFRKTSLHKPSSYLLSKLRRYEDIHKRCGPHSKSYHKALKRLKSSHGSSGGCKYIVWIPANGLGNRMLSMAATFLYALLTNRVLLVNHKTDMANLFCEPFLNTSWLLPEDFPLRNHFGRSKHGYAHSFGSMLNKSITNASMEPPEPYLDLNLALGGYDQLAFCDENQALLQKIPWLILLSDQYFVPSLFMIPSFNREISKLFPEKETVFYHLGHYLFHPSNQVWGLITRFYQAYLAKADERIGLQIRVYHDKTTPFQTVMDQILDCVLKEKLLPEVADTQEPAPPPSRNQTSKAILITSLYSEYYENMKNMYWTRPTVTGEVISVYQPSHEEYQHFGDNTHNMKAWADIYLLSLCDVLVTSTSSTFGYVAHGLAGLKPWIWRMGNKNPACQRAISMEPCCHFPLSYDCKTRIEVNAATLVPNTMHCEDRKNGLKLV

SEQ ID NO: 336 - protein, 537 aa, Arabidopsis thaliana
  REGION 1..537: note = Public GI ID no. 20138443
  REGION 36..507: note = Pfam Name: XG_FTase Pfam Description: Xyloglucan fucosyltransferase
  REGION 1..537: note = Bit score of 864.2 for HMM based on sequences of Figure 10
  REGION 1..537: note = Functional Homolog Of SEQ ID NO. 280
MYHIFQISSEVFRAFGLKMKILLTLVFSGLLIWSVVLVSFSNDFNNQLLVATSNVSRESETPRDRLIGGLLTADFDEGSCLSRYQQSLLYRKASPYKPSEYLVSKLRSYEKLHKRCGPGTDAYKKATEILGHDDENYASKSVGECRYIVWVAVYGLGNRILTLASVFLYALLTERVVLVDQSKDISDLFCEPFPGTSWLLPLEFPLMKQIDGYNKGYSRCYGTMLNNQAINSTLIPPHLYLHILHDSRDNDKMFFCQKDQSLVDKVPWLIVKANVYFVPSLWLNPTFQTELMKLFPQKEAVFHHLARYLFHPTNQVWGLITRSYNAYLSRADETLGIQIRVFSDRAGYFQHVMDQVVACTRRENLLPEPAAQEEPKVNISRSQKLKAVLVTSLYPEYSETLKNMYWERPSSTGEIIEVYQPSGERVQQTDKKLHDQKALAEMYLLSLTDKIVTSARSTFGYVAHSLGGLKPWLLYQPTGPTAPDPPCIQSTSMDPCHLTPPSHGCEPEWGTNSGKVVPFVRHCEDRGNDGLKLFDEL

SEQ ID NO: 337 - protein, 533 aa, Arabidopsis thaliana
  REGION 1..533: note = Public GI ID no. 15226501
  REGION 32..503: note = Pfam Name: XG_FTase Pfam Description: Xyloglucan fucosyltransferase
  REGION 1..533: note = Bit score of 787.1 for HMM based on sequences of Figure 10
  REGION 1..533: note = Functional Homolog Of SEQ ID NO. 280
MYQKFQISGKIVKTLGLKMKVLIAVSFGSLLFILSYSNNFNNKLLDATTKVDIKETEKPVDKLIGGLLTADFDEGSCLSRYHKYFLYRKPSPYKPSEYLVSKLRSYEMLHKRCGPDTEYYKEAIEKLSRDDASESNGECRYIVWVAGYGLGNRLLTLASVFLYALLTERIILVDNRKDVSDLLCEPFPGTSWLLPLDFPMLNYTYAWGYNKEYPRCYGTMSEKHSINSTSIPPHLYMHNLHDSRDSDKLFVCQKDQSLIDKVPWLIVQANVYFVPSLWFNPTFQTELVKLFPQKETVFHHLARYLFHPTNEVWDMVTDYYHAHLSKADERLGIQIRVFGKPDGRFKHVIDQVISCTQREKLLPEFATPEESKVNISKTPKLKSVLVASLYPEFSGNLTNMFSKRPSSTGEIVEVYQPSGERVQQTDKKSHDQKALAEMYLLSLTDNIVTSARSTFGYVSYSLGGLKPWLLYQPTNFTTPNPPCVRSKSMEPCYLTPPSHGCEADWGTNSGKILPFVRHCEDLIYGGLKLYDEF

SEQ ID NO: 338 - protein, 580 aa, Oryza sativa
  REGION 1..580: note = Public GI ID no. 125541240
  REGION 73..553: note = Pfam Name: XG_FTase Pfam Description: Xyloglucan fucosyltransferase
  REGION 1..580: note = Bit score of 710.7 for HMM based on sequences of Figure 10
  REGION 1..580: note = Functional Homolog Of SEQ ID NO. 280
  source 1..580: note = Oryza sativa subsp. indica
MDEKRAARTPRAGARNAVNGGESGCCSEKAARWGWRAPVELAVVGFVATLTLLVLLYGGTGSLLSFTSPRTEFVRKLAVQLHRAAAAASPSHGAPEDTPESSTRHDDDRLLGGLLSQAFDEHSCRSRYTSSLYRRRSPFRPSTYLVERLRRYEARHKRCGPGSALFQEAVEHLRSGRNAARSECQYVVWTPFNGLGNRMLALASTFLYALLTDRVLLVHAPPEFDGLFCEPFPGSSWTLPADFLITDFDGVFTMWSPTSYKNMRQAGTISNATAEQSLPAYVFLDLIQSFTDAAFCDDDQQVLAKFNWMVIKSDVYFAAMLFLMPAYERELTQLFPEKEAVFHHLARYLFHPSNDVWGIVHRFYEAYLARADELVGLQVRVFPEMPIPFDNMYEQIIRCSEQEGLLPKLGQTVVVTAANGSSVVAPSTKLTSILVTSLFPDYYDRIRGVYHARPTETGEYVAVHQPSHEREQRTEARGHNQRALAEIYLLSFCDRVVTSAVSTFGYIAHGLAGVRPWVLLRPPSPVARAEPACVRSETVEPCLQALPRRMCGAAEGSDIGALVPHIRHCEDVQKGVKLFS

SEQ ID NO: 339 - protein, 586 aa, Oryza sativa
  REGION 1..586: note = Public GI ID no. 115458656
  REGION 67..559: note = Pfam Name: XG_FTase Pfam Description: Xyloglucan fucosyltransferase
  REGION 1..586: note = Bit score of 734.8 for HMM based on sequences of Figure 10
  REGION 1..586: note = Functional Homolog Of SEQ ID NO. 280
  source 1..586: note = Oryza sativa subsp. japonica
MSPSIRMAPAPSSSLATAGHGKTKSGRSSSSAVRPALLAIAVSVMVVLLMAVLFGARWTPSGGHGGGADTSWVSAGARVVLNAVSSQQGADPVVKVAQPHDRLLGGLLSPDFNDTSCLSRYRASLYRRRSLHVLSSHLVSALRRYESLHRLCGPGTSAYERAVARLRSPSSSNTTSDAPSECRYLVWTPHAGLGNRMLSITSAFLYALLTGRVLLFHRSGDDMKDLFCEPFPGATWVLPEKDFPIRGMERFGIRTRESLGNALGRGEGGRDPPPPWMYVHLRHDYTRPGASDRLFFCDDGQDALRRVGWVVLLSDNYFVPGLFLIPRYERELSRMFPRRDAVFHHLGRYLFHPSNTVWGMVMRYHGSYLAKAEERVGVQVRTFSWAPISTDELYGQIVSCAQGENILPRVRESSSGSDNATAIPGSGRQQQQRPARRKAVLVVSLHGEYYERIRDMYYEHGAAGGDAVSVFQPTHLGGQRSEERMHNQKALAEMMLLSFSDVALTSAASTFGYVSHGLAGLRPWVLMVPVRKKAPNPPCRLAATVEPCFHTPPHYDCQARTKGDNGKTVRHVRHCEDLKDGVQLVD

SEQ ID NO: 340 - protein, 580 aa, Oryza sativa
  REGION 1..580: note = Public GI ID no. 125548499
  REGION 61..553: note = Pfam Name: XG_FTase Pfam Description: Xyloglucan fucosyltransferase
  REGION 1..580: note = Bit score of 724.3 for HMM based on sequences of Figure 10
  REGION 1..580: note = Functional Homolog Of SEQ ID NO. 280
  source 1..580: note = Oryza sativa subsp. indica
MSPAPSSSLATAGHGKTKSGRSSSSAVRPALLAIAVSVMVVLLMAVLFGARWTPSGGHGGGADTSWVSAGARVVLNAVSSQQGADPVVKVAQPHDRLLGGLLSPDFNDTSCLSRYRASLYRRRSLHVLSSHLVSALRRYESLHRLCGPGTSAYERAVARLRSPSSSNTTSDAPSECRYLVWTPHAGLGNRMLSITSAFLYALLTGRVLLFHRSGDDMKDLFCEPFPGATWVLPEKDFPIRGMERFGIRTRESLGNALGRGEGGRDPPPPWMYVHLRHDYTRPGASDRLFFCDDGQDALRRVGWVVLLSDNYFVPGLFLIPRYERELSRMFPRRDAVFHHLGRFLFHPSNTVWGMVMRYHGSYLAKAEERVGVQVRTFSWAPISTDELYGQIVSCAQGENILPRVRESSSGSDNATAIPGSGRQQQQRPARRKAVLVVSLHGEYYERIRDMYYEHGAAGGDAVSVFQPTHLGGQRSEERMHNQKALAEMMLLSFSDVALTSAASTFGYVSHGLAGLRPWVLMVPVRKKAPNPPCRLAATVEPCFHTPPHYDCQARTKGDNGKTVRHVRHCEDLKDGVQLVD

SEQ ID NO: 341 - DNA, 1647 bp, Sorghum bicolor
  misc_feature 1..1647: note = Ceres Annot ID no. 8654550
  misc_feature 1..1647: note = Encodes the peptide sequence at SEQ ID NO. 342
  source 1..1647: mol_type = other DNA
atggacaggaagctgaggccgctgccgcagccggcggtgaggagcgcggcgtggcccgtcggcctgctcgtcgcgctatgcttcacgacgctgccgctcttcctcgcgctgtcacccgggcggccaaccctgttcgacctgtggcagcagatcggcatcagagtagccgtgcactacgatgacgagccgaagccgtcgtcggagccctcggattcgcctctggagagccgcgacatcctcctcggcggcctgctctcgccggacgtcagcgagagcacctgcctgagccggtacctctcctcgctgtaccgcaaggcgtcgccgcactcgccgtcgccgtacctcgtgtcgcggctgcgcaagtacgaggcgctccaccgcaggtgcgggcccggcacgcccctgtacgacaagtccgtgcggcagctcgcctccgcccacaccagcatgggcctcgccgagtgcagctacctcgtgtggacgcccggcaaccacctcggcgaccgcatggtctccatggcgtccgccttcctctacgcgctgctcacccgccgcgtcttcctcgtccacatggccaaggacatggcgggcctcttctgcgagcccttccctggcgcgtcgtcgtgggagctgcccccgggcttccccgtgcacaacctcacgcagctccgccgcggcagcgagcatagctacgggaccctgctcggggccaagaagatcagcgacgaggaccccgtcggcgtgcggtccgagtcgctgccgtcgtacgcgtacctccacctggcgcacgactaccagctgcccgaccagcgcttcttctgcgacgacgaccagaccgtgctggggaaggtgaactggctgctgctgcgctccgacctctacttcgcgccggggctgttcctcgtgccgcagtttgaggacgagctccggtggatgttcccggccacggacacggtgttccaccacatcggaaggtacctgttccacccgtccaacaaggtgtggaagatgatccaggggtactacacgtcgtacatggccaagttcgatgagaagattgggattcagatcacgaccctcgccgggaaccccgtgtcgacggaggcgtacttcaaccagatcgcggcttgcacgagccaggagaagatcctgcccgaggtagaccccaaagtggcgtcgagtgagaagaaggaggcggctgcgacgtcgtcgaaggccgtgctcgtcatctcggcgcagcaggagtacgccgagaggctcaagtccatgtactacgagcacgccacggttaccggcgagccggtcagcgtgctgcagccaccgggagccggaaaccagccgcagaaccacaaggtgctggtggagatgttcctgctgagctactgcgacgtgtccgtggtgagcgggtggtcaacggtgggctacgtcggccacggcctcgccggggtgagcccgtggctgctactgccgccgacgaaccagacggtggcacacccgccctgtgtccgggcaatgtccatggagccgtgcttccacgcgccgccgacttatgactgcagggccaagacaaacggcgacctcggcgccgttctccggtgtctcaggcgttgcgaggacgtggatggtggcctcaaattgtttgattga

SEQ ID NO: 342 - protein, 548 aa, Sorghum bicolor
  REGION 1..548: note = Ceres Annot ID no. 8654550
  REGION 47..521: note = Pfam Name: XG_FTase Pfam Description: Xyloglucan fucosyltransferase
  REGION 1..548: note = Bit score of 675.3 for HMM based on sequences of Figure 10
  REGION 1..548: note = Functional Homolog Of SEQ ID NO. 280
MDRKLRPLPQPAVRSAAWPVGLLVALCFTTLPLFLALSPGRPTLFDLWQQIGIRVAVHYDDEPKPSSEPSDSPLESRDILLGGLLSPDVSESTCLSRYLSSLYRKASPHSPSPYLVSRLRKYEALHRRCGPGTPLYDKSVRQLASAHTSMGLAECSYLVWTPGNHLGDRMVSMASAFLYALLTRRVFLVHMAKDMAGLFCEPFPGASSWELPPGFPVHNLTQLRRGSEHSYGTLLGAKKISDEDPVGVRSESLPSYAYLHLAHDYQLPDQRFFCDDDQTVLGKVNWLLLRSDLYFAPGLFLVPQFEDELRWMFPATDTVFHHIGRYLFHPSNKVWKMIQGYYTSYMAKFDEKIGIQITTLAGNPVSTEAYFNQIAACTSQEKILPEVDPKVASSEKKEAAATSSKAVLVISAQQEYAERLKSMYYEHATVTGEPVSVLQPPGAGNQPQNHKVLVEMFLLSYCDVSVVSGWSTVGYVGHGLAGVSPWLLLPPTNQTVAHPPCVRAMSMEPCFHAPPTYDCRAKTNGDLGAVLRCLRRCEDVDGGLKLFD

SEQ ID NO: 343 - DNA, 1752 bp, Sorghum bicolor
  misc_feature 1..1752: note = Ceres Annot ID no. 8701112
  misc_feature 1..1752: note = Encodes the peptide sequence at SEQ ID NO. 344
  source 1..1752: mol_type = other DNA
atggatcagaagaaggtgatgaggtctcacttgtcaccgtggcgtggattggcgacgccgacgcgacggcggtggtgccaagcggccgcgcggccgacgacggttcttgtgatcgcggtgaccgtcttcgccgcgctgctcctcgccgtcgtcctcttcggcgtccggttaacgccctcgggcgtctcggccggagtacgcgtcgtcctgaaagctgtgtcgtccgaccaaggcaccggtcgtggtccattggcgacggtgccggatcccagcgaccggctgctgggcggcctcctctcgccggacttcgacgacagctcctgcctcagccgctacagcgccgcgctgtaccgccggccgtcactgcacgccgtttcctcctacctcgtctccgcgctccgccgctacgagtcgctgcaccgccgctgcggccccggcactccagcctacgcgcgcgccgtcgaactcctgcgcgcgaacgcctccgctgctacgacgacgacttcgtcctccgccgccgcctccggatcgtgcagctacgccgtgtggacgccgatcgagggcctcggcaaccgcatcctctccatcacctctaccttcctgtacgcgctcctcaccgaccgcgtcctcctcctccacagcagcagcgacgagctcgacgacctcttctgcgagccgttcccgggctccacgtggaggatcccgccgccggcggacgacaaggacaaggacggcggcttccccatcggtggcatcgagaagctcaccggctggtggcaccgcgacagccttggctccgcgctgaggcgcggcgaggaccccggcgtggcgccgtggctgtacgtgcacctgcggcacgactacaccaaggacaaccgcgaccagcagttcttctgcgacgacacgcaggccaagctggggaccgtgccgtggctcgtgttccggtccgacaactacttcgtgccggggctgttcctgatgccacggcacgaggcggagctgtcgcgcatgttcccgcgccgcgacgtcgtgttccaccacctcggccgctacctgttccacccgagcgacacggtgtggggcatggtgacccggtaccaccgctcgttcttcgccaaggcggcggacgagcgcgtcggcatccaggtgcgcaggttctattgggcgcccatctccaccgacgacctcttcggccagatcctcaactgcacgcaacgcgaggacatcctgcccggcgttccggcggcggcggcggccaaaggcagcagcagcaccgccggcgccgggaacggcggccagcaggctgggaaacagaaggccgtgctcgtcgtgtccctgcaccgggagtactccgagaagctcagggacatgtaccacgagcacggaggagcggtgagcgtgtaccagccgacgcacctgggctcgcagcgctccggcgagcgggagcacaaccagaaggcgctcgcggagatggtgctgctcagcttctcggacgcggtggtcacctccgccgcatcgacgtttgggtacgtcgggcaggggctggcggggctgaggccatgggtgcttacgagccccgtcgacaagaaggcgcccgacacgccgtgccggcgcgccgccaccatggagccgtgcttccatgtgccgctcgactacgattgtcgggcgaaagcgaaaggtgacgccggcaggagggtgcgccacatccgacactgcgaggacttcccgcagggtgtgcagttgctggaatga

SEQ ID NO: 344 - protein, 583 aa, Sorghum bicolor
  REGION 1..583: note = Ceres Annot ID no. 8701112
  REGION 53..556: note = Pfam Name: XG_FTase Pfam Description: Xyloglucan fucosyltransferase
  REGION 1..583: note = Bit score of 666.0 for HMM based on sequences of Figure 10
  REGION 1..583: note = Functional Homolog Of SEQ ID NO. 280
MDQKKVMRSHLSPWRGLATPTRRRWCQAAARPTTVLVIAVTVFAALLLAVVLFGVRLTPSGVSAGVRVVLKAVSSDQGTGRGPLATVPDPSDRLLGGLLSPDFDDSSCLSRYSAALYRRPSLHAVSSYLVSALRRYESLHRRCGPGTPAYARAVELLRANASAATTTTSSSAAASGSCSYAVWTPIEGLGNRILSITSTFLYALLTDRVLLLHSSSDELDDLFCEPFPGSTWRIPPPADDKDKDGGFPIGGIEKLTGWWHRDSLGSALRRGEDPGVAPWLYVHLRHDYTKDNRDQQFFCDDTQAKLGTVPWLVFRSDNYFVPGLFLMPRHEAELSRMFPRRDVVFHHLGRYLFHPSDTVWGMVTRYHRSFFAKAADERVGIQVRRFYWAPISTDDLFGQILNCTQREDILPGVPAAAAAKGSSSTAGAGNGGQQAGKQKAVLVVSLHREYSEKLRDMYHEHGGAVSVYQPTHLGSQRSGEREHNQKALAEMVLLSFSDAVVTSAASTFGYVGQGLAGLRPWVLTSPVDKKAPDTPCRRAATMEPCFHVPLDYDCRAKAKGDAGRRVRHIRHCEDFPQGVQLLE

SEQ ID NO: 345 - DNA, 2079 bp, Zea mays
  misc_feature 1..2079: note = Ceres Clone ID no. 1530993
  misc_feature 1..2079: note = Encodes the peptide sequence at SEQ ID NO. 346
  source 1..2079: mol_type = other DNA
aggcagccgagccatggatcagaagaaggcgatgaggtctcaccactctcacatgtcaccatggcagcgtgggttagcggcgcgacgggggtggtgccagcaggcggctgcgcggcccacgacggttcttgtgatcgtggtgaccgtgtttgccgcgctgctcttggccgtcgtcctcttcggcgtccggctcacgcccttgggcgccaacaatacctgggtctcggccggggtacgcgtcgtcctcaaagccgtgtccgactccgaccacggcactggtccactggcgacggtgccggaccccagcgaccggctgctgggcggcctcctctcgccggacttcgacgaaagctcctgcctcagccgctacagcgccgcgctctaccgccgcccgtcgctgcacgccgtttcaacctacctcgtctccgcgctccgccgctacgagtcgctgcaccggcgctgcggcccgggcactccaggctacgcgcgcgccgtcgagctcctgcgcgcgaacgcctccgctgctgcttcttcgtcctccggatcatgcagctacgccgtgtgggccccgatcgaggggctcggcaaccgcatgctctccatcacctccgccttcctctacgcgctgctcacggaccgggtgctcctcctccacagcagcggcggcggcggcgacctcgacggcctcttctgcgagccgttcccgggctccacgtggatcctgccgggcgacacgggcttccccatccgcggcatcgagcggctcacggaccggtaccaccaccagagcctgggctccgtgctgaggcgcggcgaggaccccggcgcggcgccgtggctgtacgtgcacctgcggcacgactacaccaaggacagccgcgaccagcagttcttctgcgacgacgtgcaggccaggctgggggccgtgccgtggctcgtgttccggtcggacaactacttcgtgccggggctgttcctggtcccgcggcacgaggcggagctggcgcgcatgttcccgcgccgcgacgtcgtgttccaccacctcggccgctacctcttccacccgagtgacacggtgtggggcatggtgacccagtaccacgactcgtacttcgccagcgcggacgagcgcgtggggatccaggtgcgcaggttctactgggcgccgatctccaccgacgacctcttcgcccagatcctcaactgctcgcagcgcgaggacatcctgcccagcgttggcgttcccgcggcaaaaggcggctccgacggccagcagcctgcgaaacagaaggccgtggtcgtcgtgtccctgcacggcgagtactccgagaagctcagggacctgtaccaggggcacggcggagcggcgggcggccaggaggcggtgagcgtgcaccagccgacgcacctgggctcgcagcgctccggcgagcagcagcacaaccagaaggcgctcgcggagatggtgctgctcagcttctcggacgcgctggtcacctccgcggtctcgacgttcgggtacgtagggcaggggctagcggggctgagaccttgggtgctcacgagccccgtcgacaggaagggccccgggatgccgctgccgtgccggcgcgccgctaccgtcgagccttgcttccatgcgccgctcgactacgattgtcgggccaaagcaaaaggtgacgccggtaggagggtgcggcacatccgacactgtgaggacttcccgcgaggtgtgcagttggtggaatgatgaactacgcactagtattacatcacatgggcgctcaggagctaccaagcaccagtttttcattatattacaattaaacatggggaataaatacggcattcagtctaagaggttactgtaaaaaaagttatgtaagatgaccatcgcaaatagcgtgcgttgctaggttttcttttaccacaacatttgattttttattaaaaacatttttgttaacaaatttgtttctttgtatttgtatcggtttttgctccatatgtctccgttgtatttataggcataaactctatatctgtcttccaaatgaaaggtggtattcaatttcgttt

SEQ ID NO: 346 - protein, 565 aa, Zea mays
  REGION 1..565: note = Ceres Clone ID no. 1530993
  REGION 48..538: note = Pfam Name: XG_FTase Pfam Description: Xyloglucan fucosyltransferase
  REGION 1..565: note = Bit score of 643.9 for HMM based on sequences of Figure 10
  REGION 1..565: note = Functional Homolog Of SEQ ID NO. 280
MSPWQRGLAARRGWCQQAAARPTTVLVIVVTVFAALLLAVVLFGVRLTPLGANNTWVSAGVRVVLKAVSDSDHGTGPLATVPDPSDRLLGGLLSPDFDESSCLSRYSAALYRRPSLHAVSTYLVSALRRYESLHRRCGPGTPGYARAVELLRANASAAASSSSGSCSYAVWAPIEGLGNRMLSITSAFLYALLTDRVLLLHSSGGGGDLDGLFCEPFPGSTWILPGDTGFPIRGIERLTDRYHHQSLGSVLRRGEDPGAAPWLYVHLRHDYTKDSRDQQFFCDDVQARLGAVPWLVFRSDNYFVPGLFLVPRHEAELARMFPRRDVVFHHLGRYLFHPSDTVWGMVTQYHDSYFASADERVGIQVRRFYWAPISTDDLFAQILNCSQREDILPSVGVPAAKGGSDGQQPAKQKAVVVVSLHGEYSEKLRDLYQGHGGAAGGQEAVSVHQPTHLGSQRSGEQQHNQKALAEMVLLSFSDALVTSAVSTFGYVGQGLAGLRPWVLTSPVDRKGPGMPLPCRRAATVEPCFHAPLDYDCRAKAKGDAGRRVRHIRHCEDFPRGVQLVE

SEQ ID NO: 347 - DNA, 1302 bp, Panicum virgatum
  misc_feature 1..1302: note = Ceres Clone ID no. 1776501
  misc_feature 1..1302: note = Encodes the peptide sequence at SEQ ID NO. 348
  source 1..1302: mol_type = other DNA
atccagctcggttcacacccggcgcatgaaaaagccaccctcctttccagcccgtttagctcgctataggtagcagtagagacagacagcgcgaggaacagggagcgcgcggctcagtgcagcagcagagcttgcggagagcagtagttgtgcagctcaatggcttgttccaccatggctttcttggccgtcttcgttgcggcggcggcggggtcgtgcctgccagcggccgccgcgggcgggcctctccccccggcgggaacgcccctctccttccgggagggctacacgcagctgttcggcgactccaacctcgcgctccacggcgacgggaggagggtgcacatctccctcgacgagcgaacaggcgccgggttcgcgtcgcagggcgcgtacctccacgggctcttcagcgcccgcatcaagctccccgccaaccacaccgccagcgtcgtcgtcgccttctacatgtcgaacggggacgtgtacgagcggacgcacgacgagctggacttcgagttcctggggaacgtgcgggggcgggagtggcgggtgcagaccaacgtgtacggcaacggcaacacggcggccggccgggaggagcgctacggcctctggttcgaccccacggaggacttccaccgctacgccatcctctggagccgcgacaggatcatattctacgtcgatgagacgccgatcagggaggtggtgcggacggagtccatgggcgcgcagttcccgtccaagcccatgtcgctgtacgccaccatctgggacggctccagctgggccacctcgggcggccgctacaaggtggactacaagtacgcgccctacgtcgccgagttcgccgacctcgcgctccgcggctgcgcggtgggcggtcgggcgtgcgaggagccaggcggcggcaccgccgcaccggcgatgtcgccggcgcagcggtcggcgatggaggcgttccgggcgcagcacatgacgtacggctactgctacgaccgcctccggtaccccgcgccgttgccggagtgcagcgtcggtccggaggccgcggcgttcctcccgtcgggggatgcgagggcggcactgcgtaggcgtggcaggcgccaccagacgcgcggcggcgcggactcggctgtctgatcggcggcgctgatggtgccagtgttcccaagtgtgcctgtatcgactgtggtgtggtctgatctatgattagggtcccttgattcctcctgacgggcaccaccattggtaacagtaaccggagttccactgattataagcctcttcacttgtact

SEQ ID NO: 348 - protein, 328 aa, Panicum virgatum
  REGION 1..328: note = Ceres Clone ID no. 1776501
  REGION 1..328: note = Ceres Seed Line no. UAC-17
  REGION 39..224: note = Pfam Name: Glyco_hydro_16 Pfam Description: Glycosyl hydrolases family 16
  REGION 246..292: note = Pfam Name: XET_C Pfam Description: Xyloglucan endo-transglycosylase (XET)
  REGION 1..328: note = Bit score of 828.6 for HMM based on sequences of Figure 5
  REGION 1..328: note = Figure 5
MACSTMAFLAVFVAAAAGSCLPAAAAGGPLPPAGTPLSFREGYTQLFGDSNLALHGDGRRVHISLDERTGAGFASQGAYLHGLFSARIKLPANHTASVVVAFYMSNGDVYERTHDELDFEFLGNVRGREWRVQTNVYGNGNTAAGREERYGLWFDPTEDFHRYAILWSRDRIIFYVDETPIREVVRTESMGAQFPSKPMSLYATIWDGSSWATSGGRYKVDYKYAPYVAEFADLALRGCAVGGRACEEPGGGTAAPAMSPAQRSAMEAFRAQHMTYGYCYDRLRYPAPLPECSVGPEAAAFLPSGDARAALRRRGRRHQTRGGADSAV

SEQ ID NO: 349 - DNA, 1026 bp, Sorghum bicolor
  misc_feature 1..1026: note = Ceres Annot ID no. 8642214
  misc_feature 1..1026: note = Encodes the peptide sequence at SEQ ID NO. 350
  source 1..1026: mol_type = other DNA
atggcttgttccttcctattcctggccttcctgacggcggcggtggcggcgccggcgtgtctgtcagctgcggccgcgacggccaagcttgtttccccgtcggagaagccgtccctctccttcggagaaggatacacgcagctgttcggcgactccaacctcgcgctccacggcggcggcaagagggtgcacatctccctcgacgagcgcacaggcgctgggttcgcgtcgcaggcagcgtacctccacggcagcttcagcgcccgcatcaagctgcccgccgaccacaccgccggcgtcgtcgtcgccttctacatgtcgaacggggacgtgtacgagcggacgcacgacgagctggacttcgagttcctcgggaacgtgcggggcagggagtggcgggtgcagaccaacgtgtacggcaacggcagcacggcggtcggacgggaggagcgctacggcctcccgttcgaccccacggaggacttccaccgctacgccatccactggagccgccacaggatcatattctacgtcgacgacacaccgatcagggaggtggtgcggacggaggccatgggcgcacagttcccgtccaagcccatgtcgctgtacgccaccatctgggacggctccagctgggccacctcgggaggccgctacaaggtggactacaagtacgcgccctacgtcgccgagttcgccgacctcgcgctccgcggctgcgcggtcggccccgctagcgcctcggcgtgcgcgacgcctggcagtgccagcgacgacgacgatgcctacggccgcgccgccgacgcgatctcgcccgcgcggcgttcggccatggaggcgttccgggcgcggtacatgacgtacggctactgctacgaccgcctccggtaccccgcgccgctgccggagtgcagcgtcggcgcggaggccgcggcgttcctcccgtcgggggacgcgagggcggcattgcacaggcacggtaggcgcaaccggatgcgccgcggggcggactctgccgtatga

SEQ ID NO: 350 - protein, 341 aa, Sorghum bicolor
  REGION 1..341: note = Ceres Annot ID no. 8642214
  REGION 41..226: note = Pfam Name: Glyco_hydro_16 Pfam Description: Glycosyl hydrolases family 16
  REGION 251..305: note = Pfam Name: XET_C Pfam Description: Xyloglucan endo-transglycosylase (XET)
  REGION 1..341: note = Bit score of 833.7 for HMM based on sequences of Figure 5
  REGION 1..341: note = Functional Homolog Of SEQ ID NO. 348
  REGION 1..341: note = Figure 5
MACSFLFLAFLTAAVAAPACLSAAAATAKLVSPSEKPSLSFGEGYTQLFGDSNLALHGGGKRVHISLDERTGAGFASQAAYLHGSFSARIKLPADHTAGVVVAFYMSNGDVYERTHDELDFEFLGNVRGREWRVQTNVYGNGSTAVGREERYGLPFDPTEDFHRYAIHWSRHRIIFYVDDTPIREVVRTEAMGAQFPSKPMSLYATIWDGSSWATSGGRYKVDYKYAPYVAEFADLALRGCAVGPASASACATPGSASDDDDAYGRAADAISPARRSAMEAFRARYMTYGYCYDRLRYPAPLPECSVGAEAAAFLPSGDARAALHRHGRRNRMRRGADSAV

SEQ ID NO: 351 - protein, 338 aa, Oryza sativa
  REGION 1..338: note = Public GI ID no. 115451805
  REGION 47..232: note = Pfam Name: Glyco_hydro_16 Pfam Description: Glycosyl hydrolases family 16
  REGION 247..298: note = Pfam Name: XET_C Pfam Description: Xyloglucan endo-transglycosylase (XET)
  REGION 1..338: note = Bit score of 837.7 for HMM based on sequences of Figure 5
  REGION 1..338: note = Functional Homolog Of SEQ ID NO. 348
  REGION 1..338: note = Figure 5
  source 1..338: note = Oryza sativa subsp. japonica
MAMARCSLLPILAAVLLAASLSLPPRAAAYAAMVDSLLPASATALSFEEGYTQLFGDSNLMLHGDGKRVHISLDERTGAGFASQGAYHHGFFSASIKLPADHTAGVVVAFYMSNGDVYERTHDELDFEFLGNVRGREWRVQTNVYGNGSTAAGREERYGLWFDPTQDFHRYAIRWSHDTIIFYVDETPIREVVRTASMGAQFPSKPMSLYATIWDGSSWATSGGRYKVNYKYAPYVAEFTDLLLHGCPAGSPPPCEGAAASATMPPGQRSAMERFRARHMTYGYCYDRVRYHAPLPECSVGAEAEAFLPSGEARSTDRRGGRHGKRHRRAGGGVDSAL

SEQ ID NO: 352 - DNA, 1133 bp, Triticum aestivum
  misc_feature 1..1133: note = Ceres Clone ID no. 890595
  misc_feature 1..1133: note = Encodes the peptide sequence at SEQ ID NO. 353
  source 1..1133: mol_type = other DNA
aggaacggagaggagaagcaggggagggcaccaatggcgggtcgcttcctcttggccgtcctcctggcgtcgtcctcttgggtcgctgcgtccgccggcgccgcggacgaggtcatggtcccccgcccggcggcggcgctcaccttcggggagggctacacccagctgttcggggactccaacctcaggctccacggcgacggcaagcgagtccacatctccctcgacgagaggacaggttccgggttcgcgtcgcagggcgcgtacctccacggcttcttcagcgccagcatcaaactgccgtccgactacgccgccggcgtcgtcgtcgccttctacatgtccaacggcgacgtgtacgagaagacgcacgacgagctggacttcgagttcctggggaacgtcaaggggaaggagtggagggtgcagaccaacgtgtacggcgacggcagcacggcggtcggccgggaggagcggtacggcctctggttcgaccccacgcaagacttccaccgctacgccatcctctggaccaatcgcaccatcgtgttctacgtggacgggacgccgatcagggaggtggtgaggagcgaggcgatgggggcgcagttcccgtccaagcccatgtcgctctacgccaccatctgggacggctccagctgggccacctccggcggccgctacaaggtggactacaagtacgcgccctacgtcgccgagttcaccgacctcgagctccgcggctgcgaccagccggcggcgtgcgagccggagggcggcagcgcgatgccgtccaggcagcgggcggcgatggagagggtccgggcgcggcacatgacgtacgggtactgctacgaccgcgcgcggtaccaggcgccgctgccggagtgcagggtgggcgcggaggcggccatgtacctcccgtcgggcgaggccaggtcgtcggaccggcgcaggcacggcaagcgccaccgtcgtgccggcgccgcggactcctccctctgatctgtctgaggatcgttgctgactgtgagcagcgtgctcgtgtaatcgggttatgccgtgtcatgtgtaatgtgatttgtagcttcattgttgcgtaactgagctagcaagtagcagtcgggttgacc

SEQ ID NO: 353 - protein, 323 aa, Triticum aestivum
  REGION 1..323: note = Ceres Clone ID no. 890595
  REGION 38..223: note = Pfam Name: Glyco_hydro_16 Pfam Description: Glycosyl hydrolases family 16
  REGION 244..286: note = Pfam Name: XET_C Pfam Description: Xyloglucan endo-transglycosylase (XET)
  REGION 1..323: note = Bit score of 814.5 for HMM based on sequences of Figure 5
  REGION 1..323: note = Functional Homolog Of SEQ ID NO. 348
  REGION 1..323: note = Figure 5
MAGRFLLAVLLASSSWVAASAGAADEVMVPRPAAALTFGEGYTQLFGDSNLRLHGDGKRVHISLDERTGSGFASQGAYLHGFFSASIKLPSDYAAGVVVAFYMSNGDVYEKTHDELDFEFLGNVKGKEWRVQTNVYGDGSTAVGREERYGLWFDPTQDFHRYAILWTNRTIVFYVDGTPIREVVRSEAMGAQFPSKPMSLYATIWDGSSWATSGGRYKVDYKYAPYVAEFTDLELRGCDQPAACEPEGGSAMPSRQRAAMERVRARHMTYGYCYDRARYQAPLPECRVGAEAAMYLPSGEARSSDRRRHGKRHRRAGAADSSL

SEQ ID NO: 354 - DNA, 1011 bp, Populus balsamifera
  misc_feature 1..1011: note = Ceres Annot ID no. 1463701
  misc_feature 1..1011: note = Encodes the peptide sequence at SEQ ID NO. 355
  source 1..1011: mol_type = other DNA
atggcgtgctcttatcttggtccttgttttctcttaatttgctctcttcttgcgctttttgtttctgggtctcaaattcaaagaacttcattgcctattatatcctttgatgaaggatacacccaactttttggggatgataatctggtcatgtacagagatggaaagagagtccatttatctctagatgagaggacagggtcgggatttgtttctcaggacttatacctacatggatacttcagtgcttctatcaagttgccagcagattatactgctggagttgtggttgctttttatatgtcaaatggtgacatattcgagaagaaccatgatgaaattgacttcgagttcttgggtaacataagaggcaaagattggaggatccagacaaacatttatggcaatggcagcactagtgccggcagagaagagagatacagcctctggttcgatccctctgatgatttccatcagtatagcattctctggaccaattctcagatcatattttacgtggacaacattccaattagagaggttaaaagaacagaatctatgggagcagatttcccttccaagccaatgtctttgtatgcaacgatatgggatgggtctgattgggctactaatggaggcaaatatagagtgaattacaaatacgccccttatgtcgctgaattttctgaccttgttctgcacgggtgtgctgtcgatcctgttgagcagtttccaagatgcgataatacagagagttctcaggcgatccccaccggtgtcacaccagtgcaaagaattaagatggagagctttagggccaagtttatgacatattcttattgctatgatcgggttcggtacagggctcccccatcagagtgtgtgatcaataccaaagaagcagaccgactcaaatcttacgatcctgttacttttggcggaggccggcgccaccacgggaaacgacaccaccatagtcggtcaagtcatgctgaagtcatttccatttaa

SEQ ID NO: 355 - protein, 336 aa, Populus trichocarpa
  REGION 1..336: note = Ceres Annot ID no. 1463701
  REGION 36..221: note = Pfam Name: Glyco_hydro_16 Pfam Description: Glycosyl hydrolases family 16
  REGION 247..294: note = Pfam Name: XET_C Pfam Description: Xyloglucan endo-transglycosylase (XET)
  REGION 1..336: note = Bit score of 927.0 for HMM based on sequences of Figure 5
  REGION 1..336: note = Functional Homolog Of SEQ ID NO. 348
  REGION 1..336: note = Figure 5
MACSYLGPCFLLICSLLALFVSGSQIQRTSLPIISFDEGYTQLFGDDNLVMYRDGKRVHLSLDERTGSGFVSQDLYLHGYFSASIKLPADYTAGVVVAFYMSNGDIFEKNHDEIDFEFLGNIRGKDWRIQTNIYGNGSTSAGREERYSLWFDPSDDFHQYSILWTNSQIIFYVDNIPIREVKRTESMGADFPSKPMSLYATIWDGSDWATNGGKYRVNYKYAPYVAEFSDLVLHGCAVDPVEQFPRCDNTESSQAIPTGVTPVQRIKMESFRAKFMTYSYCYDRVRYRAPPSECVINTKEADRLKSYDPVTFGGGRRHHGKRHHHSRSSHAEVISI

SEQ ID NO: 356 - DNA, 1605 bp, Gossypium hirsutum
  misc_feature 1..1605: note = Ceres Clone ID no. 1840970
  misc_feature 1..1605: note = Encodes the peptide sequence at SEQ ID NO. 357
  source 1..1605: mol_type = other DNA
aaaaaagggctgtctacatatgaacagctcaataataccctctcactcgccaatgacctgcgctatgctttcatttcaatagccttttccggctctccatcgcccccctcccatagctctagagattattcctttcttctttctttctcaaacatttattattttctcataatacatataaaaaatcatccttcttttatactcttatctttgtcttatataatctcagggtgctagagcaacaaaaatacgaccatatatcaaagggaaaaaaaaagagattcaagggataatacgatgaccaagttaccttctttgtttctggttttgactttggtttctgtttttgtttgtgggtttggaaaaaggataccaattctgtcatttgatgaagggtatagtcagttgtttggagatgataatctagttctccatagagatggtaaagctgttcacttgtctttgaatgagagaacagggtctggatttgtgtctcaagacctttacttgcatggttacttcagtgcctcaataaagttacctgctgattatactgctggagttgtggttgctttctatatgtcaaatggtgatatgttcgagaagaaccacgatgaaatagattttgagttcttgggtaacatcagaggcaaagattggaggattcagaccaatatttacggcaatggaagcaccagtgttggcagagaagaaagatacaatctttggttcgacccggctgatgatttccatcagtacactattctctggactgattctcaaatcatattttatatagacaacgtccccattagagagtttaaaagaacagctgcaatgggtggggactttccctctaagccgatgtcgttgtatgctacaatatgggatgggtctgattgggctactaatggtggcaaatatagagtcaattacaaatacgctccttacgtagccgaattttctgacctgatcctccacggctgcgcagtggatcccattgaattttcgtcgaagaagtgtgacaccacctctcaaagtttggaactttctgccactatcaccccatcacaaagaagcaaaatggatagctttaggaggaagcacatgacatattcttactgctatgaccagaccagatacaaagttccacctgtagagtgtgtgatcaatccccgtgaagccgaaagactgaaaaggttcgatccagtcacgtttggaggcaggcgtcaccatgggaagcgacaccaccgcagcagagcaagccggtccgaagctgataccatctaaaaaataataggccattggtagatttgatttcattacttgttggggcattattttcctctcggtttgatttataaaatagttgggggtcagttttgtgtatagagagagaggaggagcaggagagcaacaaatatttatctcaaagaaggtgatagagttgtttcttatcataatatatgtttgatgatgtgggtgtgtgatgtgtatagttccatttttatcattgatgtttgtctctctgtttttttacaaagattgaatttggtgatgactgttatccaataagcacttgagcatagaatatggagttcttac

SEQ ID NO: 357 - protein, 330 aa, Gossypium hirsutum
  REGION 1..330: note = Ceres Clone ID no. 1840970
  REGION 30..215: note = Pfam Name: Glyco_hydro_16 Pfam Description: Glycosyl hydrolases family 16
  REGION 242..289: note = Pfam Name: XET_C Pfam Description: Xyloglucan endo-transglycosylase (XET)
  REGION 1..330: note = Bit score of 920.4 for HMM based on sequences of Figure 5
  REGION 1..330: note = Functional Homolog Of SEQ ID NO. 348
  REGION 1..330: note = Figure 5
MTKLPSLFLVLTLVSVFVCGFGKRIPILSFDEGYSQLFGDDNLVLHRDGKAVHLSLNERTGSGFVSQDLYLHGYFSASIKLPADYTAGVVVAFYMSNGDMFEKNHDEIDFEFLGNIRGKDWRIQTNIYGNGSTSVGREERYNLWFDPADDFHQYTILWTDSQIIFYIDNVPIREFKRTAAMGGDFPSKPMSLYATIWDGSDWATNGGKYRVNYKYAPYVAEFSDLILHGCAVDPIEFSSKKCDTTSQSLELSATITPSQRSKMDSFRRKHMTYSYCYDQTRYKVPPVECVINPREAERLKRFDPVTFGGRRHHGKRHHRSRASRSEADTI

SEQ ID NO: 358 - DNA, 1260 bp, Glycine max
  misc_feature 1..1260: note = Ceres Clone ID no. 672495
  misc_feature 1..1260: note = Encodes the peptide sequence at SEQ ID NO. 359
  source 1..1260: mol_type = other DNA
ccaacctctctaactctctctctctcatcccctgctattcttcttcatcactcttctgttctcttttctcccctataataatatttccaacacaacaacactcagcagacaagtagccagaacaagaaaatcctttgacacattgatcacttcctttaaggaaacaaacatggaagggggtcacatggggtggttcctcttctgttgttgtttttctctacttttttttcattcttctgggtcacccagaagaaacttgcccatcatagcctttgaggatggctacacccccttgtttggggaccataatttggccatccatagagatggcaaatcagttcacctttcacttgatgaaagaacaggttctggatttgtgtctcatgacctttaccttcacgggtatttcagtgcctcgatcaagctgcctgctgattacactgctggagttgtggttgcattttatatgtcaaatggtgaaatgttccagaacaaccatgatgagatagactttgagtttttggggaacattagaggcaaagactggaggattcagacaaatgtttatggcaatggaagcaccagcattggtagagaggaaagatatggcttatggtttgatcctgctgaggatttccatcagtacagtattctttggacagattctaagatcatattttatgtggataatgttcctattagggaagttaaaagaacagaatctatgggaggagatttcccctcaaagccaatgaccatgtatgctaccatatgggatgcatctgattgggcaaccaatggaggcaaatacagggtaaattacaagtatgcaccctatgttgctgagttctctgacctgatcctgcatggttgtgcagttgatcccatagagcatgtggccaagtgtgaaagtgcccaaggttctgagaaagttccctctggtgtcaccccagtacaaataaccaaaatgagaaacttcaggttgaagcacatggcttactcttactgctatgacacagttagatacaaagtccctccaccagagtgtgtcatcaaccaccaagaagctgaaaggcttagaaaatttgatcccgtcactttcggcaacggccagcgccaccgtgggaaacgacaccmccatagtagtaaaggaagccaggaagagattactgcttcttcattttaatgtatggctccatatgcagattttgtcataaagaaaatattttcatatatgaatcagtttgatttacctgggtc

SEQ ID NO: 359 - protein, 338 aa, Glycine max
  REGION 1..338: note = Ceres Clone ID no. 672495
  REGION 35..220: note = Pfam Name: Glyco_hydro_16 Pfam Description: Glycosyl hydrolases family 16
  REGION 246..293: note = Pfam Name: XET_C Pfam Description: Xyloglucan endo-transglycosylase (XET)
  REGION 1..338: note = Bit score of 899.5 for HMM based on sequences of Figure 5
  REGION 1..338: note = Functional Homolog Of SEQ ID NO. 348
  REGION 1..338: note = Figure 5
  VARIANT 323: note = X can be any amino acid
MEGGHMGWFLFCCCFSLLFFHSSGSPRRNLPIIAFEDGYTPLFGDHNLAIHRDGKSVHLSLDERTGSGFVSHDLYLHGYFSASIKLPADYTAGVVVAFYMSNGEMFQNNHDEIDFEFLGNIRGKDWRIQTNVYGNGSTSIGREERYGLWFDPAEDFHQYSILWTDSKIIFYVDNVPIREVKRTESMGGDFPSKPMTMYATIWDASDWATNGGKYRVNYKYAPYVAEFSDLILHGCAVDPIEHVAKCESAQGSEKVPSGVTPVQITKMRNFRLKHMAYSYCYDTVRYKVPPPECVINHQEAERLRKFDPVTFGNGQRHRGKRHXHSSKGSQEEITASSF

SEQ ID NO: 360 - protein, 332 aa, Vitis vinifera
  REGION 1..332: note = Public GI ID no. 225424452
  REGION 30..215: note = Pfam Name: Glyco_hydro_16 Pfam Description: Glycosyl hydrolases family 16
  REGION 230..289: note = Pfam Name: XET_C Pfam Description: Xyloglucan endo-transglycosylase (XET)
  REGION 1..332: note = Bit score of 934.4 for HMM based on sequences of Figure 5
  REGION 1..332: note = Functional Homolog Of SEQ ID NO. 348
  REGION 1..332: note = Figure 5
MVDSCLLLLLICSVLGLVSGSSKELPIISFDEGYSPLFGDANLAILKDGETVHMSLDERTGSGFISQDLYLHGFFSASIKLPADYTAGVVVAFYMSNADMFEANHDELDFEFLGNIRGKDWRIQTNVYGNGSTNVGREERYHLWFDPSEDFHQYSILWSDNLIIFYVDNVPIREIKRTEAMGGDFPSKPMSLYATIWDGSEWATNGGRYRVNYKYAPYVAEFSNLVLHGCAVDPIEKSPKCDNGPTSKASIPTGIMPEQRSKMEKFRKTHMTYSYCYDRVRYTVPPSECVVNAQEAERLRRFDPVTFGGRRHHHHGKRHQRNRSSQGEATTI

SEQ ID NO: 361 - protein, 332 aa, Arabidopsis thaliana
  REGION 1..332: note = Public GI ID no. 15223878
  REGION 31..216: note = Pfam Name: Glyco_hydro_16 Pfam Description: Glycosyl hydrolases family 16
  REGION 242..290: note = Pfam Name: XET_C Pfam Description: Xyloglucan endo-transglycosylase (XET)
  REGION 1..332: note = Bit score of 880.2 for HMM based on sequences of Figure 5
  REGION 1..332: note = Functional Homolog Of SEQ ID NO. 348
  REGION 1..332: note = Figure 5
MGFITRFLVFMSLFTSLVSGFALQKLPLIQFDEGYTQLFGDQNLIVHRDGKSVRLTLDERTGSGFVSNDIYLHGFFSSSIKLPADYSAGVVIAFYLSNGDLYEKNHDEIDFEFLGNIRGREWRIQTNIYGNGSTHLGREERYNLWFDPTEDFHQYSILWSLSHIIFYVDNVPIREVKRTASMGGDFPAKPMSLYSTIWDGSKWATDGGKYGVNYKYAPYVSQFTDLILHGCAVDPTEKFPSCKDEAVQNLRLASEITESQRNKMEIFRQKHMTYSYCYDHMRYKVVLSECVVNPAEAKRLRVYDPVTFGGIPHGHRRGKHRSRSRLARTESI

SEQ ID NO: 362 - protein, 330 aa, Daucus carota
  REGION 1..330: note = Public GI ID no. 13560781
  REGION 30..215: note = Pfam Name: Glyco_hydro_16 Pfam Description: Glycosyl hydrolases family 16
  REGION 241..288: note = Pfam Name: XET_C Pfam Description: Xyloglucan endo-transglycosylase (XET)
  REGION 1..330: note = Bit score of 905.1 for HMM based on sequences of Figure 5
  REGION 1..330: note = Functional Homolog Of SEQ ID NO. 348
  REGION 1..330: note = Figure 5
MVNLYVNLFVMCSVVVLAHGSSRNLPIVSFEEGYSQLFGDSNLMILQDGKSAHLSLDERTGSGFVSHDLYKHGFFSASIKLPADYTAGVVVAFYMSNVDMFAKNHDEIDFEFLGNIRGKEWRLQTNVYGNGSTGAGREERYGLWFDPSDDFHQYSILWSKDRIIFYIDNVPIREVKKTEAMGGDFPSKPMSLYATIWDGSNWATNGGKYKVNYKYSPYIAEFSDFVLHGCAVDPIEMSTSCDTAPKSQSVPTGTTKESRTKMQNLRKKYMQYSYCYDTTRYQVPPSECVIDPLESERLRGFDPVTFGTSHRGHGKRHHNRRSYRHGINSV

SEQ ID NO: 363 - protein, 314 aa, Solanum lycopersicum
  REGION 1..314: note = Public GI ID no. 6681351
  REGION 14..199: note = Pfam Name: Glyco_hydro_16 Pfam Description: Glycosyl hydrolases family 16
  REGION 225..272: note = Pfam Name: XET_C Pfam Description: Xyloglucan endo-transglycosylase (XET)
  REGION 1..314: note = Bit score of 859.0 for HMM based on sequences of Figure 5
  REGION 1..314: note = Functional Homolog Of SEQ ID NO. 348
  REGION 1..314: note = Figure 5
LVSGFSENLETSSFNEGYSQLFGHDNLMVIQDGKSVHISLDERTGAGFVSQDLYLHGLFSASIKLPEDYTAGVVVAFYMSNGDMFEKNHDEIDFEFLGNIRAKNWRIQTNIYGNGSTNVGGEERYGLWFDPTEDFHTYTILWTDSHIIFYVDNVPIREIKRTQAMSEDFPSKPMSLYGTIWDGSSWATNGGKYKVNYKYAPYVAKFSDFVLHGCGVDPIELSPKCDIVLDSASIPTRISPDQRRKMERFRNKYLQYSYCYDRTRYNVPQSECVIDPKEANRLRGFDPMTFGGVPRHQNKRHHQRQSRREDTSAK

SEQ ID NO: 364 - protein, 352 aa, Picea sitchensis
  REGION 1..352: note = Public GI ID no. 116786783
  REGION 46..231: note = Pfam Name: Glyco_hydro_16 Pfam Description: Glycosyl hydrolases family 16
  REGION 259..309: note = Pfam Name: XET_C Pfam Description: Xyloglucan endo-transglycosylase (XET)
  REGION 1..352: note = Bit score of 810.0 for HMM based on sequences of Figure 5
  REGION 1..352: note = Functional Homolog Of SEQ ID NO. 348
  REGION 1..352: note = Figure 5
MALAVALVALVFIWVCGFSQLASAVGSSRPRLAGKRVTENFASLRFEEGYTSLFGEDNVKVAEDGKAVMLSLDKRTGSGLLSQDMYMYGLFSASIKLPDDYTAGVVVAFYTSNGDIFQGTHDELDFEFLGNIRGKEWRIQTNVYGNGSTAFGREERYTLWFDPTEDFHQYTILWTDKRTLFFVDDVPIREIPRTAAMGAHYPSKPMSVYATVWDGSDWATKGGRYRVNYKYSPFVVSLSNLVLEGCAVDPLEQFHTVSCPADTTSSDSLSQFSELSEDQKALMEWFRSKYISYSYCDDDVRYPTTPADCPPRDPHKKIATAHVRFGHHQRHRKKNRKSHRSSSGAAAAVVSL

SEQ ID NO: 365 - protein, 338 aa, Oryza sativa
  REGION 1..338: note = Public GI ID no. 125543052
  REGION 47..232: note = Pfam Name: Glyco_hydro_16 Pfam Description: Glycosyl hydrolases family 16
  REGION 247..298: note = Pfam Name: XET_C Pfam Description: Xyloglucan endo-transglycosylase (XET)
  REGION 1..338: note = Bit score of 836.2 for HMM based on sequences of Figure 5
  REGION 1..338: note = Functional Homolog Of SEQ ID NO. 348
  source 1..338: note = Oryza sativa subsp. indica
MAMARCSLLPILAAVLLAASLSLPPRAAAYAAMVDSLLPASATALSFEEGYTQLFGDSNLMLHGDGKRVHISLDERTGAGFASQGAYHHGFFSASIKLPADHTAGVVVAFYMSNGDVYERTHDELDFEFLGNVRGREWRVQTNVYGNGSTAAGREERYGLWFDPTQDFHRYAIRWSHDTIIFYVDETPIREVVRTASMGAQFPSKPMSLYATIWDGSSWATSGGRYKVNYKYAPYVAEFTDLLLHGCPAGSPPPCEGAAASATMPPGQRSAMERFRTRHMTYGYCYDRVRYHAPLPECSVGAEAEAFLPSGEARSTDRRGGRHGKRHRRAGGGVDSAL

SEQ ID NO: 366 - protein, 336 aa, Populus tremula
  REGION 1..336: note = Public GI ID no. 124109193
  REGION 36..221: note = Pfam Name: Glyco_hydro_16 Pfam Description: Glycosyl hydrolases family 16
  REGION 247..294: note = Pfam Name: XET_C Pfam Description: Xyloglucan endo-transglycosylase (XET)
  REGION 1..336: note = Bit score of 906.3 for HMM based on sequences of Figure 5
  REGION 1..336: note = Functional Homolog Of SEQ ID NO. 348
MACSYFCTCSLLICSLLAFLVSGSQIQKTFLPVISFDEGYTQLFGDDNLAIHRDGKTVHLSLDERTGSGFVSQDLYLHGYFSASIKLPADYTAGVVVAFYMSNGDIFEKNHDEIDFEFLGNIRGKDWRIQTNIYGNGSTSVGREERYSLWFDPSEDFHQYSILWTDSQITFYVDNVPIREFKRTESMGGDFPSKPMSLYATIWDGSGWATNGGKYRVNYKYAPYVTEFSDLVLHGCAVDPIEQFPKCDNTESSEAIPTGVTTVQRIKMESFRAKFMTYSYCYDRVRYKVPPSECVINPKEADRLKSFDPVTFGGGRRHHGKRHHRSRAGHVEAISI

SEQ ID NO: 367 - DNA, 1032 bp, Sorghum bicolor
  misc_feature 1..1032: note = Ceres Annot ID no. 8653921
  misc_feature 1..1032: note = Encodes the peptide sequence at SEQ ID NO. 368
  source 1..1032: mol_type = other DNA
atggcgtctcccccgctgctgctgctgctgccgatgcacgcgctcgccgtagtcctcgtgctcgccctgtccgcccgcggcgccgaggccaggccgccgccgccgctccacggcgtgcgcccgctcgccttcgacgaggggtacacccagatcttcggcagcgccaacctcgcgctcctccgcgacggccggcgcgtccgcctcacgctcgacgagtccaccggcgccgggttcgcatcgcaggacgtcttcctccacggcttcttcagcgccgccatcaagctgcccgccgactacgcggcgggcgtcgtcgtcgcgttctacctgtccaacggcgacgtgtacgagaagacgcacgacgagctggacttcgagttcctgggcaacgtgcgcgggcgcgagtggcgggtgcagaccaacgtgtacggcaacggcagcacccacgccggccgggaggagcgctacgacctccccttcgaccccaccgacgacttccaccactactccatcctctggaccaacgaccgcatcatcttctacgtcgacgagactccgatcagggaggtggtgcggacgtcggcgatgggcgcggcgttcccgtccaagcccatgtccctgtacgccaccatctgggacggctcctcctgggcgacgctgggcggccggtaccgcgtcaactacaagtacgcgccgttcgtggccgagttcgccgacctcgccatccagggctgcgccgtcgaccccaccgacctctcctcggcctccgcggcggcgtcgtgcggcgcgggcctgggcgcgctcgccgtgtccgtgtccgcggagcagctcgcggccatggcggcgttccggcgcgcccacacctcctactcctactgccacgaccggcggcggtaccccgtggcgctgtcggagtgcgggtccggcaaggggctcctccccagccgcatgttcggccccgacgggatgaagcagcaccggcgccacagggccgcgccgcgcggtcaccgtggcgcccaggacgacgtcatgtga

SEQ ID NO: 368 - protein, 343 aa, Sorghum bicolor
  REGION 1..343: note = Ceres Annot ID no. 8653921
  REGION 44..229: note = Pfam Name: Glyco_hydro_16 Pfam Description: Glycosyl hydrolases family 16
  REGION 260..305: note = Pfam Name: XET_C Pfam Description: Xyloglucan endo-transglycosylase (XET)
  REGION 1..343: note = Bit score of 665.7 for HMM based on sequences of Figure 5
  REGION 1..343: note = Functional Homolog Of SEQ ID NO. 348
MASPPLLLLLPMHALAVVLVLALSARGAEARPPPPLHGVRPLAFDEGYTQIFGSANLALLRDGRRVRLTLDESTGAGFASQDVFLHGFFSAAIKLPADYAAGVVVAFYLSNGDVYEKTHDELDFEFLGNVRGREWRVQTNVYGNGSTHAGREERYDLPFDPTDDFHHYSILWTNDRIIFYVDETPIREVVRTSAMGAAFPSKPMSLYATIWDGSSWATLGGRYRVNYKYAPFVAEFADLAIQGCAVDPTDLSSASAAASCGAGLGALAVSVSAEQLAAMAAFRRAHTSYSYCHDRRRYPVALSECGSGKGLLPSRMFGPDGMKQHRRHRAAPRGHRGAQDDVM

SEQ ID NO: 369 - DNA, 1326 bp, Panicum virgatum
  misc_feature 1..1326: note = Ceres Clone ID no. 1995976
  misc_feature 1..1326: note = Encodes the peptide sequence at SEQ ID NO. 370
  source 1..1326: mol_type = other DNA
gagaggaggggacagagaggcagggaggtgtgtgggagtaggtgtgttgtggagtcgagcgggatggcgtccggcgcgtcgtcgtctcccccgctgccggtgctctcgctcgccgcggtcgtcgtcgtcctcctcctcctcgcggcgcgcggcggggccacgccgccgcacccgctccgcggcgtgcgcccgctcgccttcgacgaggggtacgcccagatcttcggcagcagcaacctcgcgctcctccgcgacggccgccgcgtccgcctcgccctcgacgagtccaccggcgccgggttcgcgtcgcaggacctgttcctccacggcttcttcagcgccgccatcaagctgcccgccgactacgccgcgggcgtcgtcgtcgcgttctacctgtcgaacggcgacgtgtacgagaagacccacgacgagctggacttcgagttcctgggcaacgtgcgggggcgcgagtggcgggtgcagaccaacgtctacggcaacggcagcacccacgccggccgggaggagcgctacgacctccccttcgaccccaccgacgacttccaccactactccatcctctggaccagccaacgcatcatattctacgtggacgagaccccgatccgggaggtggtgcggacggcggccatgggcgcggcgttcccgtccaagcccatgtctttgtacgccaccatctgggacggctccacctgggccacgctgggcggccggtaccgcgtcaactaccggtacgcgccgtttgtggccgagttcgccgacctcgtcatccggggctgcgccggcgaccccgccgagcgcgacccccactcggcggccgcggcggcgtgcgaggcgcgcgccgggctggaggccctcgccgtgcccgcggagcggcgcgcggccatggcggcgttccggcgcgcccacacctcctactcctactgccacgaccggcggcggtaccccgtggccctggcggagtgcggcgcggcggcgctcctcccgggccgcatgttcggccccgacggcatgaggcaacacggccggcgcgcccgccgcggcggtcgccgcgtcggcgcccaggacgacgccatgtgatggatcgatcgatctcccggctcaatctccgattcttaaggctggctgtataaaggcggagctgggcaggcggcgggcgggcgggcgtgattgcttgcggtgggattgggattggagcgagtcgtcttcctcggcttgcgttgtggttgtacggtacccccggcctgctctctgcccccattcgccattagagtagctctcgtgtttattgccgcgctggaccat

SEQ ID NO: 370 - protein, 345 aa, Panicum virgatum
  REGION 1..345: note = Ceres Clone ID no. 1995976
  REGION 46..231: note = Pfam Name: Glyco_hydro_16 Pfam Description: Glycosyl hydrolases family 16
  REGION 263..308: note = Pfam Name: XET_C Pfam Description: Xyloglucan endo-transglycosylase (XET)
  REGION 1..345: note = Bit score of 656.9 for HMM based on sequences of Figure 5
  REGION 1..345: note = Functional Homolog Of SEQ ID NO. 348
MASGASSSPPLPVLSLAAVVVVLLLLAARGGATPPHPLRGVRPLAFDEGYAQIFGSSNLALLRDGRRVRLALDESTGAGFASQDLFLHGFFSAAIKLPADYAAGVVVAFYLSNGDVYEKTHDELDFEFLGNVRGREWRVQTNVYGNGSTHAGREERYDLPFDPTDDFHHYSILWTSQRIIFYVDETPIREVVRTAAMGAAFPSKPMSLYATIWDGSTWATLGGRYRVNYRYAPFVAEFADLVIRGCAGDPAERDPHSAAAAACEARAGLEALAVPAERRAAMAAFRRAHTSYSYCHDRRRYPVALAECGAAALLPGRMFGPDGMRQHGRRARRGGRRVGAQDDAM

SEQ ID NO: 371 - DNA, 1296 bp, Zea mays
  misc_feature 1..1296: note = Ceres Clone ID no. 369312
  misc_feature 1..1296: note = Encodes the peptide sequence at SEQ ID NO. 372
  source 1..1296: mol_type = other DNA
accgggctgaggaggccatcggacgcacaaggacagcagagtgcaggaccggagcggagcgaccgagagtgtgtgggagagagatggcgtccagcgcctcgtctaccctgccgctgccaacgctctcgctcgccgtgatcctgctcgcgctgtgcgcccgcggcggcgaggccaggccgccaccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggtttcttcagcgccgccatcaagctgcccgccgactacgcggcgggcgtcgtcgtcgcgttctacctgtcgaacggcgacgtgtacgagaagacgcacgacgagctggacttcgagttcctgggcaacgtgcggggccgcgagtggcgggtgcagaccaacgtgtacggcaacggcagcaccgacgccggccgggaggagcgctacgacctcccattcgaccccaccgacgacttccaccactactccatcctctggaccagcgaccgcatcactttctacgtcgacgagaccccgatccaggaggtggtgcggacggcggccatgggcgcggcgttcccgtccaagcccatgtccctgtacgccacgatctgggacggctccgcgtgggccacgctgggcggccggtaccgcgtcaactacaagtacgcgccgttcgtggccgagttcgccgacctcgccatccagggcttcgccgtcgaccccgccgccgaccacgccgtggcgtcgtgcggcgcgggcctgggcctgggcctgggcccgggcccgctcgccgtgtccgcggagcagcgctcggccatggcggcgttccggcgcgcccacacctcctactcctactgccacgaccggcggcggtaccccgtcgcgctgtcggagtgcggggccggcgcggggctcctccccggccgcatgtttggccccgacgggatgaagcagcaccggcgccacctggggcgcggcgcgcggccaccgcggcggcgcccaggacgacgacgtcatgtgatcgccggtccctggcccctcgccacgtcgcggcggcggggcggggatggttgcacgctgtggattggattggattggattgggttgggggggttgggcggggattgtccgggatggaaaagctcgcctcattgtaccattcgcgccatggaagtaggtcgtgtttattgcc

SEQ ID NO: 372 - protein, 404 aa, Zea mays
  REGION 1..404: note = Ceres Clone ID no. 369312
  REGION 44..229: note = Pfam Name: Glyco_hydro_16 Pfam Description: Glycosyl hydrolases family 16
  REGION 257..306: note = Pfam Name: XET_C Pfam Description: Xyloglucan endo-transglycosylase (XET)
  REGION 1..404: note = Bit score of 638.5 for HMM based on sequences of Figure 5
  REGION 1..404: note = Functional Homolog Of SEQ ID NO. 348
MASSASSTLPLPTLSLAVILLALCARGGEARPPPPLHGVRPLAFDEGYTQIFGSANLALLRDGRRVRLTLDESTGAGFASQDVFLHGFFSAAIKLPADYAAGVVVAFYLSNGDVYEKTHDELDFEFLGNVRGREWRVQTNVYGNGSTDAGREERYDLPFDPTDDFHHYSILWTSDRITFYVDETPIQEVVRTAAMGAAFPSKPMSLYATIWDGSAWATLGGRYRVNYKYAPFVAEFADLAIQGFAVDPAADHAVASCGAGLGLGLGPGPLAVSAEQRSAMAAFRRAHTSYSYCHDRRRYPVALSECGAGAGLLPGRMFGPDGMKQHRRHLGRGARPPRRRPGRRRHVIAGPWPLATSRRRGGDGCTLWIGLDWIGLGGLGGDCPGWKSSPHCTIRAMEVGRVYC

SEQ ID NO: 373 - protein, 315 aa, Oryza sativa
  REGION 1..315: note = Public GI ID no. 17047034
  REGION 45..206: note = Pfam Name: Glyco_hydro_16 Pfam Description: Glycosyl hydrolases family 16
  REGION 232..279: note = Pfam Name: XET_C Pfam Description: Xyloglucan endo-transglycosylase (XET)
  REGION 1..315: note = Bit score of 656.4 for HMM based on sequences of Figure 5
  REGION 1..315: note = Functional Homolog Of SEQ ID NO. 348
MAASRCFLLLLLLLLSPLLASAGEEEEEAVLAMAARLRRPAAASFREGYTQLFGDSNLALHGDGKRVRISLDERTGAGFASQDAYLHGFFSASIKLPPDYAAGVVVAFYMSNGDVYEKTHDELDFEFLGNIKGREWRVQTNVYGNGSTSVGREERFYIDETPIREVQRTKSMGVQFPSKPMSLYATIWDGSSWATSGGRYKVNYKYAPFVAEFSELMLHGCAMDTLTRAPMCTPDIANIHNAVAMSGRQRSAMERFRTKYMTYGYCYDRLRYPTPPSECNVGPEAELFLPTGEARSIDRHGRARRHRRGPADSAF

SEQ ID NO: 374 - protein, 336 aa, Populus trichocarpa
  REGION 1..336: note = Public GI ID no. 118482018
  REGION 36..221: note = Pfam Name: Glyco_hydro_16 Pfam Description: Glycosyl hydrolases family 16
  REGION 247..294: note = Pfam Name: XET_C Pfam Description: Xyloglucan endo-transglycosylase (XET)
  REGION 1..336: note = Bit score of 899.4 for HMM based on sequences of Figure 5
  REGION 1..336: note = Functional Homolog Of SEQ ID NO. 348
MACSYLCPCSLLICSLLAFLVSGSQIQRTLLPVISFDEGYTQLFGDDNLAIHRDGKTVHLSLDERTGSGFVSQDLYLHGYFSASIKLPADYTAGVVVAFYMSNGDIFEKNHDEIDFEFLGNIRGKDWRIQTNIYGNGSTSVGREERYSLWFDPSDDFHQYSILWTDSQITFYVDNVPIREFKRTESMGGDFPSKPMSLYATIWDGSGWATNGGKYRVNYKYAPYVTEFSDLVLHGCAVDPIEQFPKCDNSESSEVIPTGVTTVQRIKMESFRAKFMTYSYCYDRVRYKVPPSECVFNPKVADRLKSFDPVTFGGGRRHHGKRHHRSRASHVEAISI

SEQ ID NO: 375 - protein, 315 aa, Oryza sativa
  REGION 1..315: note = Public GI ID no. 125530964
  REGION 45..206: note = Pfam Name: Glyco_hydro_16 Pfam Description: Glycosyl hydrolases family 16
  REGION 232..279: note = Pfam Name: XET_C Pfam Description: Xyloglucan endo-transglycosylase (XET)
  REGION 1..315: note = Bit score of 650.0 for HMM based on sequences of Figure 5
  REGION 1..315: note = Functional Homolog Of SEQ ID NO. 348
  source 1..315: note = Oryza sativa subsp. indica
MAASRCFLLLLLLLLSPLLASAGEEEEEAVLAMAARLRRPAAASFREGYTQLFGGSNLALHGDGKRVRISLDERTGAGFASQDAYLHGFFSASIKLPPDYAAGVVVAFYMSNGDVYEKTHDELDFEFLGNIKGREWRVQTNVYGNGSTSVGREERFYIDETPIREVQRTKSMGVQFPSKPMSLYATIWDGSSWATSGGRYKVNYKYAPFIAEFSELMLHGCAMDTLTRAPMCTPDIANIHNAVAMSGRQRSAMERFRTKYMTYGYCYDRLRYPTPPSECNVGPEAELFLPTGEARSIDRHGRARRHRRGPADSAF

SEQ ID NO: 376 - protein, 332 aa, Oryza sativa
  REGION 1..332: note = Public GI ID no. 125563629
  REGION 45..230: note = Pfam Name: Glyco_hydro_16 Pfam Description: Glycosyl hydrolases family 16
  REGION 258..301: note = Pfam Name: XET_C Pfam Description: Xyloglucan endo-transglycosylase (XET)
  REGION 1..332: note = Bit score of 631.3 for HMM based on sequences of Figure 5
  REGION 1..332: note = Functional Homolog Of SEQ ID NO. 348
  source 1..332: note = Oryza sativa subsp. indica
MVVVVAMPPALSLLVLLVLALHGGAGDATPPPPLRLVRGALRVAFDEGYTRMFGDGNLAVLRDGRRVRLTLDESTGAGFASQDVFLHGFFSAAVKLPAYYAAGVVVAFYLSNGDTYEKTHDEVDFEFLGNVRGREWRVQTNVYGNGSTAAGREERYDLPFDPTDELHHYSILWTRRRIIFYVDETPIREVVRTAAMGAAFPAKPMSVYATIWDGSAWATLGGRYRVNYRYAPFVAEFADLVLHGCAVDPLAVEHSASCGDEEEEAAEAVVSSAAMAAFRRGHMSYSYCHDRRRYPVALSECALTGGAASLGRLFGPDGMKRRRARRVRDASS

SEQ ID NO: 377 - protein, 332 aa, Vitis vinifera
  REGION 1..332: note = Public GI ID no. 147797772
  REGION 30..215: note = Pfam Name: Glyco_hydro_16 Pfam Description: Glycosyl hydrolases family 16
  REGION 230..289: note = Pfam Name: XET_C Pfam Description: Xyloglucan endo-transglycosylase (XET)
  REGION 1..332: note = Bit score of 930.2 for HMM based on sequences of Figure 5
  REGION 1..332: note = Functional Homolog Of SEQ ID NO. 348
MVDSCLLLLLICSVLGLVSGSSKELPIISFDEGYSPLFGDANLAILKDGKTVHMSLDERTGSGFISQDLYLHGFFSASIKLPADYTAGVVVAFYMSNADMFEANHDELDFEFLGNIRGKDWRIQTNVYGNGSTNVGREERYHLWFDPSEDFHQYSILWSDNLIIFYVDNVPIREIKRTEAMGGDFPSKPMSLYATIWDGSEWATNGGRYRVNYKYAPYEAEFSNLVLHGCAVDPIEKSPKCDNGPTSKASIPTGIMPEQRSKMEKFRKTHMTYSYCYDRVRYTVPPSECVVNAQEAERLRRFDPVTFGGRRHHHHGKRHQRNRSSQGEATTI

SEQ ID NO: 378 - DNA, 1335 bp, Arabidopsis thaliana
  misc_feature 1..1335: note = Ceres Clone ID no. 18876
  misc_feature 1..1335: note = Encodes the peptide sequence at SEQ ID NO. 379
  source 1..1335: mol_type = other DNA
aatattcactctctcttcttcattagcctttcgtctccttcttctcttctctatctctctttagcttctctacgcaagcttattatctctttctcttaaagctttttctatatacaaacagaagcgtttgatactgtaaaaaagatttagaaatggagactctgagtcgtttattggttttcatgtctctgttttccggtttagtttctggatttgctctgcaaaatcttccaatcacatcttttgaagaaagttacactcaactttttggtgacaagaacttatttgttcatcaagatggcaaatctgtccggttaacgctcgatgaaagaaccggttccggttttgtttcaaatgattattacttgcatggattcttcagtgcttctatcaaattaccttctgattatacagctggagttgttgttgccttttatatgtctaatggagatatgtatgagaagaatcatgatgagatagattttgagtttcttggtaacattagagaaaaagaatggagagttcagacaaacatttacggtaatggaagtactcattcaggaagagaagagagatataatctctggtttgatcctactgaagattttcatcaatacagtatcctctggtctgattctcacatcatattctttgtagacaatgttcctattagagaggtcaaacgtactgcggaaatgggtggtcactttccatcaaagccgatgtctctctacacaacaatatgggacggttctaaatgggcgactaacggtgggaagtacggtgtaaactacaaatatgcgccttacattgcccggttctcggatctagtcctgcacggctgccccgtggaccctatcgagcagtttccgaggtgtgatgaaggcgcggctgaggatattcgtgcggcgcaagagattacaccttcacaaaggagtaaaatggatgttttcagacggagactcatgacatattcatattgctatgatcgggctaggtacaatgttgctttatcggagtgtgtggtgaatcccgctgaggctcaaaggcttagggtttatgatccggtcagatttggcggcattccgaggcgccaccgcaatggaaagcaccggagcaagagaagccgggttgatggaaccaagtcgatatgataacatatataggcaaaatagtatgggtgagatttgggggttctataataagtccattattttggttatttatgattcaatgcattttcacagagagaggaggcatttttgtcatttgttagttgtatatcattataagaaaagaaaaaataattaatttatttatttgtgatattttttt

SEQ ID NO: 379 - protein, 333 aa, Arabidopsis thaliana
  REGION 1..333: note = Ceres Clone ID no. 18876
  REGION 31..216: note = Pfam Name: Glyco_hydro_16 Pfam Description: Glycosyl hydrolases family 16
  REGION 242..290: note = Pfam Name: XET_C Pfam Description: Xyloglucan endo-transglycosylase (XET)
  REGION 1..333: note = Bit score of 835.5 for HMM based on sequences of Figure 5
  REGION 1..333: note = Functional Homolog Of SEQ ID NO. 348
METLSRLLVFMSLFSGLVSGFALQNLPITSFEESYTQLFGDKNLFVHQDGKSVRLTLDERTGSGFVSNDYYLHGFFSASIKLPSDYTAGVVVAFYMSNGDMYEKNHDEIDFEFLGNIREKEWRVQTNIYGNGSTHSGREERYNLWFDPTEDFHQYSILWSDSHIIFFVDNVPIREVKRTAEMGGHFPSKPMSLYTTIWDGSKWATNGGKYGVNYKYAPYIARFSDLVLHGCPVDPIEQFPRCDEGAAEDIRAAQEITPSQRSKMDVFRRRLMTYSYCYDRARYNVALSECVVNPAEAQRLRVYDPVRFGGIPRRHRNGKHRSKRSRVDGTKSI

SEQ ID NO: 380 - protein, 354 aa, Oryza sativa
  REGION 1..354: note = Public GI ID no. 125540767
  REGION 36..221: note = Pfam Name: Glyco_hydro_16 Pfam Description: Glycosyl hydrolases family 16
  REGION 253..304: note = Pfam Name: XET_C Pfam Description: Xyloglucan endo-transglycosylase (XET)
  REGION 1..354: note = Bit score of 568.5 for HMM based on sequences of Figure 5
  REGION 1..354: note = Functional Homolog Of SEQ ID NO. 348
  source 1..354: note = Oryza sativa subsp. indica
MALEARFFLAAVFAVAATCLCLSAVASAFAVPSVAFDEGYSPLFGDDNLVRSSDDKSVRLLLDRRSGSGFISSDYYLHGFFSASIKLPKAYTAGVVVAFYLSNGDVYEKTHDELDFEFLGSRWGGQWRVQTNVYGNGSTARGREERYLLPFDPTLEAHRYSVLWAPTHIIFYIDDTPIREVIRHPGMGGDFPSKPMAVYATIWDGSTWATDGGKYKVNYKYAPFASEFSDLALLGCRADPVLRAPRDGGGAGCAEPDLLGLLTADYAIMTPRKRAAMRAFRARHMTYTVCYDAVRYAAGPFPECDVSDVEKESFSAWGESKNVVMKARGRGRRRGRKAGVAGAGAMSRLDVSSS

SEQ ID NO: 381 - protein, 351 aa, Oryza sativa
  REGION 1..351: note = Public GI ID no. 115448069
  REGION 36..221: note = Pfam Name: Glyco_hydro_16 Pfam Description: Glycosyl hydrolases family 16
  REGION 253..304: note = Pfam Name: XET_C Pfam Description: Xyloglucan endo-transglycosylase (XET)
  REGION 1..351: note = Bit score of 565.7 for HMM based on sequences of Figure 5
  REGION 1..351: note = Functional Homolog Of SEQ ID NO. 348
  source 1..351: note = Oryza sativa subsp. japonica
MALEARFFLAAVFAVAATCLCLSAVASAFAVPSVAFDEGYSPLFGDDNLVRSSDDKSVRLLLDRRSGSGFISSDYYLHGFFSASIKLPKAYTAGVVVAFYLSNGDVYEKTHDELDFEFLGSRWGGQWRVQTNAYGNGSTARGREERYLLPFDPTLEAHRYSVLWAPTHIIFYIDDTPIREVIRHPGMGGDFPSKPMAVYATIWDGSTWATDGGKYKVNYKYAPFASEFSDLALLGCRADPVLRAPRDGGGAGCAEPDLLGLLTADYAVMTPRKRAAMRAFRARHMTYTVCYDAVRYAAGPFPECDVSDVEKESFSAWGESKNVVMKARGRGRRRGRKAGAGAMSRLDVSSS

SEQ ID NO: 382 - DNA, 1362 bp, Triticum aestivum
  misc_feature 1..1362: note = Ceres Clone ID no. 683310
  misc_feature 1..1362: note = Encodes the peptide sequence at SEQ ID NO. 383
  source 1..1362: mol_type = other DNA
agaacccggggagcgcgtgaggttttggttcttgaatcttgagaggcgaaagagaaagaaaggaagagagagcgacgccttgagagcaccagactgcgcagcaatggcgatgaaggcgaggttgttggcggcggcggcgacgtgcgtctgcctggcggcggcggcctccgccttcgacgtgccgaccgtggccttcgaggaagggttctcgccgctgttcggggacggcaaccttgtccgcgcgcgggatgacagggccgcccgcctcttgctcgatcgccgctccggttcgggattcatctcctcggattactacctgcacggcttcttcagcgcgtccatcaagctgcccagggactacacggccggcgtcgtcgtcgccttctacctgtcgaacggggacgtgtacgagaagacgcacgacgagctggacctcgagttcctgggcagccggtggggcgggcagtggcgggtgcagaccaacgtctacggcaacggcagcaccagccgcggccgggaggagcgctacctcctccccttcgaccccaccctcgaggcccaccgctactccatcctctgggcccccacccacatcatattctacgtggacgacacgccgatccgcgaggtggtccggcaccccggcatgggcggggacttcccggccaagcccatggcggtgtacgccaccatctgggacggctccgcctgggccacggagggcggcaagtacaaggtcaactacaagtacgcgcccttcgcctccgacttctccgacctctccctccgaggatgccgcgtcgccgacccggcggcgctgagcagcgacgccgccggcgggtgcgacctcctgaggctcatgacggccgactacgcggtcatgaccccgcagaagcgcgccgccatgcgcgcgttccgggcgcgccagatgacctacacggtctgctacgacgcggcgcggtacgcggccggcccgttcccggagtgcgacaactcggacgaggagaggggcacgttctgggcgtggggcgagtccaagaccgtggtcatgaagacgcgcggccgcgggcgccgcggccgggggagcaggaccggcgccggagcaaggggacgcgccggcgcggcgagcagctgagctcttacttgacaggacactaatggctatggatttgattgatttttgggcggcgttatatgatttcggtgtctctgtataggttggtcgtagggattagtagctcattgttttttactgctaggagtattactattctttgattcgttggatggcagctaataatatgatcagattattactatggctactttcggttttttttcttcaaaagcaccattttcagc

SEQ ID NO: 383 - protein, 343 aa, Triticum aestivum
  REGION 1..343: note = Ceres Clone ID no. 683310
  REGION 31..216: note = Pfam Name: Glyco_hydro_16 Pfam Description: Glycosyl hydrolases family 16
  REGION 247..295: note = Pfam Name: XET_C Pfam Description: Xyloglucan endo-transglycosylase (XET)
  REGION 1..343: note = Bit score of 551.7 for HMM based on sequences of Figure 5
  REGION 1..343: note = Functional Homolog Of SEQ ID NO. 348
MAMKARLLAAAATCVCLAAAASAFDVPTVAFEEGFSPLFGDGNLVRARDDRAARLLLDRRSGSGFISSDYYLHGFFSASIKLPRDYTAGVVVAFYLSNGDVYEKTHDELDLEFLGSRWGGQWRVQTNVYGNGSTSRGREERYLLPFDPTLEAHRYSILWAPTHIIFYVDDTPIREVVRHPGMGGDFPAKPMAVYATIWDGSAWATEGGKYKVNYKYAPFASDFSDLSLRGCRVADPAALSSDAAGGCDLLRLMTADYAVMTPQKRAAMRAFRARQMTYTVCYDAARYAAGPFPECDNSDEERGTFWAWGESKTVVMKTRGRGRRGRGSRTGAGARGRAGAASS

SEQ ID NO: 384 - protein, 319 aa, Oryza sativa
  REGION 1..319: note = Public GI ID no. 125605601
  REGION 45..230: note = Pfam Name: Glyco_hydro_16 Pfam Description: Glycosyl hydrolases family 16,
  REGION 235..300: note = Pfam Name: XET_C Pfam Description: Xyloglucan endo-transglycosylase (XET)
  REGION 1..319: note = Bit score of 552.4 for HMM based on sequences of Figure 5
  REGION 1..319: note = Functional Homolog Of SEQ ID NO. 348
  source 1..319: note = Oryza sativa subsp. japonica
MVVVVAMPPALSLLVLLVLALHGGAGDATPPPPLRLVRGARRVAFDEGYTRMFGDGNLAVLRDGRRVRLTLDESTGAGFASQDVFLHGFFSAAVKLPAYYAAGVVVAFYLSNGDTYEKTHDEVDFEFLGNVRGREWRVQTNVYGNGSTAAGREERYDLPFDPTDELHHYSILWTRRRIIFYVDETPIREVVRTAAMGAAFPAKPMSVYATIWDGSAWATLGGRYRVNYRYAPFVAEFADLVLHGCAVDPLAVEHSASCGDEEEEAAEAVVSSAAMAAFRARATCPTPTATTGGGTRSRCPSARSPAAQPPSAACSAPTG

SEQ ID NO: 385 - DNA, 1180 bp, Gossypium hirsutum
  misc_feature 1..1180: note = Ceres Clone ID no. 1922671
  misc_feature 1..1180: note = Encodes the peptide sequence at SEQ ID NO. 386
  source 1..1180: mol_type = other DNA
aaggtaattgaattaagttatgggtctcttaagctgctctatttctgaaaccataaccccttccctccttttcttcttcttgttttgtttcatcggcttcggtactgctactttcaacgtcaccaccctcgcctttgatgaaggttacaaccctctctttggcgatggcaatcttgttcgttccccggatggtcatagcgtccgcctcctcctcgacgtttatactgggtcgggttttatttcgtctcgtatgtatcaacatggatttttcagtgccaaaatcaaattaccatcagactatactgctggaatagtcgttgccttctatacatcaaacggtgacgtattcgagaaaaaccacgatgaattagacatcgagtttttaggaaatattgaaggtaaaccatggagattccagacaaatgtgtatgggaatggcagcacgaaccgaggccgagaggaacgctataacctttggtttgatccatcaaaagaattccatagatacagcattttatggacagccaagaacatcatattttatgtcgatgaagttccgattagggaagtggtacgcaatgatgcaatgggtggagactacccatcaaagccaatgtctttgtatgcaacaatttgggatgcctctagctgggccaccaacggaggaaaatataaagttaattacgaatatgcccctttcacttccgagtttaaagacctagtccttgacggttgcgccatcgatcccatccagaaattccccaactccactgcctgctccgagacagatacctggctcgagagccgtgactacgccgtcataacaccgaaaagccgatccgccatgcgaagattcaggcagcgttacatgtactattcatattgttatgacaatgtgcgttaccctataacacctcccgagtgcgcagttgattcaaacgaaaaacaaaggttccgtaacaccgggaggttgagattcggtggaagccataggaagcaagcgaggatggaaagagcacgccgaaagagaaggtcacgggctgcttccgtctccgatgatcaaaccgatatgtgaacataccattgagtttgtaaattaaaaatgtcattgtctcaaaatcattttttttcaatcttatttatttcatacatatatatatgttaaataattgggtttggc

SEQ ID NO: 386 - protein, 351 aa, Gossypium hirsutum
  REGION 1..351: note = Ceres Clone ID no. 1922671
  REGION 39..224: note = Pfam Name: Glyco_hydro_16 Pfam Description: Glycosyl hydrolases family 16
  REGION 239..302: note = Pfam Name: XET_C Pfam Description: Xyloglucan endo-transglycosylase (XET)
  REGION 1..351: note = Bit score of 652.2 for HMM based on sequences of Figure 5
  REGION 1..351: note = Functional Homolog Of SEQ ID NO. 348
MGLLSCSISETITPSLLFFFLFCFIGFGTATFNVTTLAFDEGYNPLFGDGNLVRSPDGHSVRLLLDVYTGSGFISSRMYQHGFFSAKIKLPSDYTAGIVVAFYTSNGDVFEKNHDELDIEFLGNIEGKPWRFQTNVYGNGSTNRGREERYNLWFDPSKEFHRYSILWTAKNIIFYVDEVPIREVVRNDAMGGDYPSKPMSLYATIWDASSWATNGGKYKVNYEYAPFTSEFKDLVLDGCAIDPIQKFPNSTACSETDTWLESRDYAVITPKSRSAMRRFRQRYMYYSYCYDNVRYPITPPECAVDSNEKQRFRNTGRLRFGGSHRKQARMERARRKRRSRAASVSDDQTDM

SEQ ID NO: 387 - DNA, 1237 bp, Zea mays
  misc_feature 1..1237: note = Ceres Clone ID no. 100961902
  misc_feature 1..1237: note = Encodes the peptide sequence at SEQ ID NO. 388
  source 1..1237: mol_type = other DNA
ttgaccgccggtcggcgagcggagcatacgtgcatacatggtttgcttgacgccggcggcggcggcgctgctgctgctcgtcgtcgtcctagcggcggccgtgtccgcgctcccggcgatcaacgtgacgacgatggcgttcgaggacgggtacgcgccgctgttcgggcacggcaacatcctccgctccgccgaccaccgcaccgtcagcctcctcctcgaccgttccaccgggtccggtttcatctcgtcgtccatgtaccagcacggcttcttcagcgcgtccatcaagctcccctccgactacaccgccggcgtcgtcgtcgccttctacgcgtccaacggcgacgtgttcgagaagcggcacgacgagctggacttcgagttcctgggcaacatccggggcaagccatggcgggtgcagaccaacgtgtacggaaacggcagcgtgggccggggccgggaggagcggtacgtgctccccttcgacccaaccacggagttccaccgctactccatcctgtggacgcccgccgccgtggccttctacgtggacgacgtgccggtgcgcgaggtgcggcagtcggccgccatgggcggggacttcccctccaagcccatgtccgtgtacgccaccgtgtgggacgcctccacctgggccaccgccgggggccggtaccgcgtcaactaccgctacgggcccttcgtcgcctccttcaccgacctggccctcctcggctgccgcgtcgacgggcccatccagcagacgacggcggagcggtgcgccgcagccgccgaggcactcagggcgtcggacgtggccgtcatgacggtggagaagcagcaggccatgcgcaggttccgggagcgcaacatggtctactcctactgctacgacacgctgcgctaccccgccgcgttccccgagtgcgacgtcgtcgagtcggagcgcaggcggttcaaggacaccggacacctccgcttcgcgctgcggcggcggatgagcccgcgacgctcccacggcagggcggccagcagggacagggtcagggagctcaagaagcgcgcggcggacatgtagcattcgtgtagactgtagtagcggtcggcgatggtaatggatattcacgcctgccgctgttaatctattggatacgaatacgatacgcatcgtacagcatcacagttcacaggagtagcggaatggcgagggcgaaaaaaaataccttttgtcttc

SEQ ID NO: 388 - protein, 347 aa, Zea mays
  REGION 1..347: note = Ceres Clone ID no. 100961902
  REGION 35..220: note = Pfam Name: Glyco_hydro_16 Pfam Description: Glycosyl hydrolases family 16
  REGION 249..298: note = Pfam Name: XET_C Pfam Description: Xyloglucan endo-transglycosylase (XET)
  REGION 1..347: note = Bit score of 599.6 for HMM based on sequences of Figure 5
  REGION 1..347: note = Functional Homolog Of SEQ ID NO. 348
MVCLTPAAAALLLLVVVLAAAVSALPAINVTTMAFEDGYAPLFGHGNILRSADHRTVSLLLDRSTGSGFISSSMYQHGFFSASIKLPSDYTAGVVVAFYASNGDVFEKRHDELDFEFLGNIRGKPWRVQTNVYGNGSVGRGREERYVLPFDPTTEFHRYSILWTPAAVAFYVDDVPVREVRQSAAMGGDFPSKPMSVYATVWDASTWATAGGRYRVNYRYGPFVASFTDLALLGCRVDGPIQQTTAERCAAAAEALRASDVAVMTVEKQQAMRRFRERNMVYSYCYDTLRYPAAFPECDVVESERRRFKDTGHLRFALRRRMSPRRSHGRAASRDRVRELKKRAADM

SEQ ID NO: 389 - DNA, 1047 bp, Populus balsamifera
  misc_feature 1..1047: note = Ceres Annot ID no. 1447077
  misc_feature 1..1047: note = Encodes the peptide sequence at SEQ ID NO. 390
  source 1..1047: mol_type = other DNA
atggattgcttatgttgttggtctgtctcgaaacctttgtatctcctcctcttcttttacttcttttcttgcactgccaaagcagctttcaatctctccaccatctcctttgatgaaggttacagccctctctttggcgatggcaatcttgttcgctctcctgatggtagaagcgcccgcctcctccttgatcgcttcacaggtgcgggttttatttcatccaggatgtataaatatggattctttagtgcgaatatcaagttaccaggctattacacggccggtctctgtgttgccttttatacatcgaacggggacgtgttcaagaagacccatgatgaattggacattgaattcctgggaaacaccaaaggggagccatggaggttccaaacaaacttgtatggtaatggaagcacaagtcatggcagagaagaaagatatcgattgtggtttgacccctccaaagagttccataggtatagcattctatggacggcaaagaacatcatattctacattgacgatgttcccatccgagaggtgattcgcaatgaagaaatgggcagcgagttcccatcgaagccaatgtccttgtatgctacgatatgggatgcgtcgaattgggcaacttctggtgggaaatacaaggtcaattataagtatgcaccatttgtgtccgaatttaaggacttggctctcgagggctgcccttctgaccccatcgaggaatttccttcatttgattgctatgagagtgatattgctaggctcgagaatgccgattatgccacgatcacgcggaggcaacgttcggcaatgcggcgattccgccaacgttacatgtattattcttattgctatgatgcattaaggtatcctgtgccactaccagaatgtgttataattccatcagagaaggagagattcagggacactggcagattgaaattcggtggcagccatcaaggtggcaaacgccgttcaaggcgccgaggccgaggccgagttcaagcttctaatttagaatatgatccggatatgtga

SEQ ID NO: 390 - protein, 348 aa, Populus trichocarpa
  REGION 1..348: note = Ceres Annot ID no. 1447077
  REGION 37..222: note = Pfam Name: Glyco_hydro_16 Pfam Description: Glycosyl hydrolases family 16
  REGION 237..300: note = Pfam Name: XET_C Pfam Description: Xyloglucan endo-transglycosylase (XET)
  REGION 1..348: note = Bit score of 618.5 for HMM based on sequences of Figure 5
  REGION 1..348: note = Functional Homolog Of SEQ ID NO. 348
MDCLCCWSVSKPLYLLLFFYFFSCTAKAAFNLSTISFDEGYSPLFGDGNLVRSPDGRSARLLLDRFTGAGFISSRMYKYGFFSANIKLPGYYTAGLCVAFYTSNGDVFKKTHDELDIEFLGNTKGEPWRFQTNLYGNGSTSHGREERYRLWFDPSKEFHRYSILWTAKNIIFYIDDVPIREVIRNEEMGSEFPSKPMSLYATIWDASNWATSGGKYKVNYKYAPFVSEFKDLALEGCPSDPIEEFPSFDCYESDIARLENADYATITRRQRSAMRRFRQRYMYYSYCYDALRYPVPLPECVIIPSEKERFRDTGRLKFGGSHQGGKRRSRRRGRGRVQASNLEYDPDM

SEQ ID NO: 391 - DNA, 1262 bp, Glycine max
  misc_feature 1..1262: note = Ceres Clone ID no. 1643790
  misc_feature 1..1262: note = Encodes the peptide sequence at SEQ ID NO. 392
  source 1..1262: mol_type = other DNA
aaaactaaggagtggagagagaaaaaaaaaaaaaaaaaacagaacaacacagaaactcaaaaccaaaataaaattattatggatcatattcataggttacgttgttttgggacaatacccaaaattccttttctattgctactttccctgcttctcttcagtttcgttaacgcatccttcgacctcgctactatacccttcaacgacggctattctccgctcttcggagctagcaacgttgttcgctccgaggatggatacggcgtacaactccgcctcgatcgctacacaggttcgggtttcatttcctccagtatgtaccagtatggattcttcagcgcgagaatcaagttaccatcgaattatagtgctggtatttgcgtggccttttatacatcaaacggtgatgtgttcgagaagtcccatgatgagttggactttgaattcctaggtaacgttgccggaaaaccatggcgatttcagacgaacttgtacggcaacggcagcacaaatcgtggccgtgaggagcggtaccgtctgtggttcgatccaaccaaagaattccacagatacagcatcctttggaccgcaaagaatgtcatattttacattgatgaagttccaattagagaagtgctacaaagtgaagaaatgggaggtgactacccatcaaagccaatgtcattatacgccaccatatgggatgcatcaaattgggccacatccggtggaaaatacaaagtgaactataagtatgcaccttttgtgaccgaattcaaggacctagtcctaaagggttgctccgccgatcccattcaagaggttaccggcaccaagtcttgctccgaccaacacgctgatctcgaggctcaagactatgccggcgtgacccccatgcgccgcctcaccatgcggcggttccgtcagcgttacatgtactattcatattgctatgatactttaaggtaccctgtgccacaacccgagtgtgtcattgtaccctccgagaaacaaaggtttaaggagaccggaaggttgaaatttggcggcagtcaccaccggcaatctcgacggaggggccgtacaacaactccggtggatcataccgatcagggtgatatgtgatgattgatattgagatgtatataatagtgtcaattttttagatctttatttgtggttttttttttttacattatatatttatttgccgacaggcataaataaaccaatcgatttatatatggtctttatttttgttt

SEQ ID NO: 392 - protein, 348 aa, Glycine max
  REGION 1..348: note = Ceres Clone ID no. 1643790
  REGION 41..226: note = Pfam Name: Glyco_hydro_16 Pfam Description: Glycosyl hydrolases family 16
  REGION 241..304: note = Pfam Name: XET_C Pfam Description: Xyloglucan endo-transglycosylase (XET)
  REGION 1..348: note = Bit score of 617.2 for HMM based on sequences of Figure 5
  REGION 1..348: note = Functional Homolog Of SEQ ID NO. 348
MDHIHRLRCFGTIPKIPFLLLLSLLLFSFVNASFDLATIPFNDGYSPLFGASNVVRSEDGYGVQLRLDRYTGSGFISSSMYQYGFFSARIKLPSNYSAGICVAFYTSNGDVFEKSHDELDFEFLGNVAGKPWRFQTNLYGNGSTNRGREERYRLWFDPTKEFHRYSILWTAKNVIFYIDEVPIREVLQSEEMGGDYPSKPMSLYATIWDASNWATSGGKYKVNYKYAPFVTEFKDLVLKGCSADPIQEVTGTKSCSDQHADLEAQDYAGVTPMRRLTMRRFRQRYMYYSYCYDTLRYPVPQPECVIVPSEKQRFKETGRLKFGGSHHRQSRRRGRTTTPVDHTDQGDM

SEQ ID NO: 393 - protein, 341 aa, Oryza sativa
  REGION 1..341: note = Public GI ID no. 125580663
  REGION 35..220: note = Pfam Name: Glyco_hydro_16 Pfam Description: Glycosyl hydrolases family 16
  REGION 250..299: note = Pfam Name: XET_C Pfam Description: Xyloglucan endo-transglycosylase (XET)
  REGION 1..341: note = Bit score of 583.4 for HMM based on sequences of Figure 5
  REGION 1..341: note = Functional Homolog Of SEQ ID NO. 348
  source 1..341: note = Oryza sativa subsp. japonica
MAGRRLLVATAVVAAAAAVVAAAALEAINVTTVAFEEGYTPLFGFDNILRSADDRTVSLLLDRSTGSGFMSSSMYQHGFFSASIKLPSDYTAGVVVAFYTSNGDVIEKRHDELDFEFLGNIRGKPWRVQTNVYGNGSVSRGREERYLLPFDPTTEFHRYSILWTRAAIVFFVDDVPIREVRRTPAMTGDFPSKPMSIYATVWDASTWATSGGRYRVNYRYGPFVASFTDLALLGCRVGDPIGQMLSSAACTAAEDALLASDLAVMTLEKQQAMRRFREQNMVYSYCYDTLRYPAPFLECDVVESERRRFKGNGQLRLGFRRRPAEPAPGSRPARPTRAADM

SEQ ID NO: 394 - protein, 352 aa, Picea sitchensis
  REGION 1..352: note = Public GI ID no. 116785331
  REGION 46..231: note = Pfam Name: Glyco_hydro_16 Pfam Description: Glycosyl hydrolases family 16
  REGION 259..309: note = Pfam Name: XET_C Pfam Description: Xyloglucan endo-transglycosylase (XET)
  REGION 1..352: note = Bit score of 801.9 for HMM based on sequences of Figure 5
  REGION 1..352: note = Functional Homolog Of SEQ ID NO. 348
MALAVALVALVFIWGCGFSQLASAVGSSRPRLAGKRVTENFASLRFEEGYTSLFGEDNVKVAEDGKAVMLSLDKRTGSGLLSQDMYMYGLFSASIKLPDDYTAGVVVAFYTSNGDIFQGTHDELDFEFLGNIRGKEWRIQTNVYGNGSTAFGREERYTLWFDPTEDFHQYTILWTDKRTLFFVDDVPIREIPRTAAMGAHYPSKPMSVYATVWDGSDWATKGGRYRVNYKYSPFVVSLSNLVLEGCAVDPLEQFHTVSCPADTTSSDSLSQFSELSEDQKALMEWFRGKYISYSYCDDDVRYPTTPADCPPRDPHKKIATAHVRFGHHQRHRKKNRKSHRSSSGAADAVVSL

SEQ ID NO: 395 - DNA, 1041 bp, Populus balsamifera
  misc_feature 1..1041: note = Ceres Annot ID no. 1485570
  misc_feature 1..1041: note = Encodes the peptide sequence at SEQ ID NO. 396
  source 1..1041: mol_type = other DNA
atggattgcttatgctgttggtctctctcgaaacctttctatctccttctcttccttttctcctttccttgtataattgccagcgcagctttcaatctctccaccatctcctttgatgaaggttacagccccctctttggcgacggcaaccttgttcgttctcctgatggtagaaccgcccgcctcctccttgatcgcttcacaggtgcgggttttatttcatccaagatgtataaatatggattctttagtgccaacatcaagttaccaggcgactacactgccggtctctgcgttgccttctatacatcaaacggggacgtgttcgagaagacccatgatgaattggactttgaattcctaggaaacactgaagggaagccatggaggttccaaacaaacttgtatggtaatggaagcacgagtcgtggcagagaagaaagatatcgattatggtttgacccttccaaacagttccataggtatagcattctatggacggcaaagaacaccatattctacatcgatgatgttcccatccgagaggtgattcgcagtgaagaaatgggcggcgagtacccatcaaaaccaatgtccctgtatgctacaatatgggatgcgtcaaattgggcaacttctggtggcaaatacaaggtcaattataagtatgcaccatttgtgtccgaatttaaggactttgtcctagagggatgcccttctgaccccatcgaggaatttccttctgtggattgctatgagagttattccaggcttgagagtgccgattatgccaccataacaaggagacaacggtcagctatgcgtaaatttcgccagcgttacatgtattattcttactgctatgattcattaaggtatcccgtgccaccaccagaatgtgttgtgattccaacagagaaggacaggttcagggacactggtagattgagattcggtggcagccatcaaggccgcaaacgccgctcaaggcggcgaggtcgagttcaagtttctagtatagaatatgatccggatgtgtga

SEQ ID NO: 396 - protein, 346 aa, Populus trichocarpa
  REGION 1..346: note = Ceres Annot ID no. 1485570
  REGION 38..223: note = Pfam Name: Glyco_hydro_16 Pfam Description: Glycosyl hydrolases family 16
  REGION 251..300: note = Pfam Name: XET_C Pfam Description: Xyloglucan endo-transglycosylase (XET)
  REGION 1..346: note = Bit score of 643.7 for HMM based on sequences of Figure 5
  REGION 1..346: note = Functional Homolog Of SEQ ID NO. 348
MDCLCCWSLSKPFYLLLFLFSFPCIIASAAFNLSTISFDEGYSPLFGDGNLVRSPDGRTARLLLDRFTGAGFISSKMYKYGFFSANIKLPGDYTAGLCVAFYTSNGDVFEKTHDELDFEFLGNTEGKPWRFQTNLYGNGSTSRGREERYRLWFDPSKQFHRYSILWTAKNTIFYIDDVPIREVIRSEEMGGEYPSKPMSLYATIWDASNWATSGGKYKVNYKYAPFVSEFKDFVLEGCPSDPIEEFPSVDCYESYSRLESADYATITRRQRSAMRKFRQRYMYYSYCYDSLRYPVPPPECVVIPTEKDRFRDTGRLRFGGSHQGRKRRSRRRGRVQVSSIEYDPDV

SEQ ID NO: 397 - DNA, 1056 bp, Sorghum bicolor
  misc_feature 1..1056: note = Ceres Annot ID no. 8681188
  misc_feature 1..1056: note = Encodes the peptide sequence at SEQ ID NO. 398
  source 1..1056: mol_type = other DNA
atggcggcgaaggcgagggtctcgctgacggtcttgctcgccgccgcgacgttggcgtgcttatgtgccgtggccgcctccgcctccgccttcgacgtgccgtccgtggccttcgaggagcggttctcgccgctgttcggcgacggcaacgttgtccgctcctccgacgacaggagcgtccgcctcctgctcgaccgccggtcaggttccgggttcatctcttcggactactacctccacggcttcttcagcgcgtccatcaagctgcccaaggactacacggccggcgtcgtcgtcgccttctacctgtctaatggggacgtgtacgagaagacgcacgacgagctggacttcgagttccttggcagccggtggggcgggcagtggcgcgtgcagaccaacgtctacggcaacggcagcaccagccatggccgggaggaacgctacctcctccccttcgaccccaccctcgaggcccacagctactccatcctatgggctcccactcacataatcttctacatcgacgacacgccgatccgggaggtgatccggcacccggacatgggcggcgacttcccggcgaagccgatggcggtgtacgccaccatctgggacggctccgcgtgggccacggacgggggcaagtacaaggtcaactacaagtacgcgccgttcgcgtccgacttctccgagctggccgtcgtcggcttccgcgccgacccggtgctccgcgtcgcgcaccgccacggcgcccgccaggccgacctcctcggcctcatgacggccgactacgccgtcatgacgccgcagaagcgcgcggccatgcgcgccttcagggcgcggcagatgacgtacacggtgtgctacgacgccgtgcggtacgcggacgggccgttcccggagtgcgacaactcggacgaggagagggagtccttctccgcctggggggaatccaagaccgtcgtcatgaggccccgcgcccgaggccgccgccggggacgcaaggccggcgccggtgccagggtaccgccggctgacgtgtcaagcagctga

SEQ ID NO: 398 - protein, 351 aa, Sorghum bicolor
  REGION 1..351: note = Ceres Annot ID no. 8681188
  REGION 38..223: note = Pfam Name: Glyco_hydro_16 Pfam Description: Glycosyl hydrolases family 16
  REGION 255..303: note = Pfam Name: XET_C Pfam Description: Xyloglucan endo-transglycosylase (XET)
  REGION 1..351: note = Bit score of 521.7 for HMM based on sequences of Figure 5
  REGION 1..351: note = Functional Homolog Of SEQ ID NO. 348
MAAKARVSLTVLLAAATLACLCAVAASASAFDVPSVAFEERFSPLFGDGNVVRSSDDRSVRLLLDRRSGSGFISSDYYLHGFFSASIKLPKDYTAGVVVAFYLSNGDVYEKTHDELDFEFLGSRWGGQWRVQTNVYGNGSTSHGREERYLLPFDPTLEAHSYSILWAPTHIIFYIDDTPIREVIRHPDMGGDFPAKPMAVYATIWDGSAWATDGGKYKVNYKYAPFASDFSELAVVGFRADPVLRVAHRHGARQADLLGLMTADYAVMTPQKRAAMRAFRARQMTYTVCYDAVRYADGPFPECDNSDEERESFSAWGESKTVVMRPRARGRRRGRKAGAGARVPPADVSSS

SEQ ID NO: 399 - DNA, 1488 bp, Panicum virgatum
  misc_feature 1..1488: note = Ceres Clone ID no. 1818189
  misc_feature 1..1488: note = Encodes the peptide sequence at SEQ ID NO. 400
  source 1..1488: mol_type = other DNA
accgcgtataaaggaagccaagattattagcgagccccaggccaagaaacgcgtcagagtttggctcttgataggacgccgccggtgcaagaggcagagagaggagagagagagagagagagaaagagagagagagagagagagaggcggcggaggaagaggaaggaggaggaggaggtgaggtcaggggccgagagggagccagccgctatacggccagccatggcggccagggccgggttcttgctcgccgccgcggcgtgggtgtgcctatcggctgtgtccgcctccgccttcgacgacgtgccgaccgcagccttcgacgagcggttctcgtcgctgttcggcgacggcaacctcgtccgctcctccgacgacaggagcgtccgcctcctgctcgaccgccgctccggttccgggttcatgtcctcgcactactacctccacggcttcttcagcgcctccatcaagctgcccaaggactacacggccggcgtcgtcgtcgccttctacctgtcgaacggggacgtgtacgagaagacgcacgacgagctggacttcgagttcctgggcagccggtggggcggccagtggcgcgtgcagaccaacgtctacggcaacggcagcaccagccgcgggcgcgaggagcgctacctcctccccttcgaccccaccctcgaggcccaccgctactccgtcctctgggctcccacccacatcatcttctacatcgatgacacgccgatccgggaggtgatccggcacccggacatgggcggcgacttcccggcgaagccgatggcggtgtacgccaccatctgggacggctccgcgtgggccacggaggggggcaagtacaaggtcaactacaagtacgcgccgttcgcgtccgagttctcggacctcgccgtcgtcggcccccgcgccgacccggtgctccgcgtcccccgccgcggcggcgcgggtgaccaggacgacgaccaggacctgctggggctcatgacggccgactacgccgtcatgacgccgcagaagcgcgccgccatgcgcgcgttcagggcgcggcacatgacgtacaccgtgtgctacgacgccgcgcggtacgcgtcgggccccatcccggagtgcgacaactcggacgaggagcgcgagaacttctccgcctggggcgagtccaagaccgtcgtcatgaggcctcgcgcccgtggccgccgccgggggcgcaaggccggcggcgccgccgccgccaggggacgcgcggcaagcagctgagatcagaagcaatcaggaatagatcgggttgcgaaagctattggcacaatggttgcagatgatcaattgatccgggactgtaattcgatctacctttttggggtgtccgttgcagatgcaggttgtaaaggtaggtgtagggactagtagggattaatgcgttatgattattctttcatttcttgggtggcagctaataataatatggagtatgat

SEQ ID NO: 400 - protein, 349 aa, Panicum virgatum
  REGION 1..349: note = Ceres Clone ID no. 1818189
  REGION 33..218: note = Pfam Name: Glyco_hydro_16 Pfam Description: Glycosyl hydrolases family 16
  REGION 258..302: note = Pfam Name: XET_C Pfam Description: Xyloglucan endo-transglycosylase (XET)
  REGION 1..349: note = Bit score of 526.0 for HMM based on sequences of Figure 5
  REGION 1..349: note = Functional Homolog Of SEQ ID NO. 348
MAARAGFLLAAAAWVCLSAVSASAFDDVPTAAFDERFSSLFGDGNLVRSSDDRSVRLLLDRRSGSGFMSSHYYLHGFFSASIKLPKDYTAGVVVAFYLSNGDVYEKTHDELDFEFLGSRWGGQWRVQTNVYGNGSTSRGREERYLLPFDPTLEAHRYSVLWAPTHIIFYIDDTPIREVIRHPDMGGDFPAKPMAVYATIWDGSAWATEGGKYKVNYKYAPFASEFSDLAVVGPRADPVLRVPRRGGAGDQDDDQDLLGLMTADYAVMTPQKRAAMRAFRARHMTYTVCYDAARYASGPIPECDNSDEERENFSAWGESKTVVMRPRARGRRRGRKAGGAAAARGRAASS

SEQ ID NO: 401 - DNA, 1341 bp, Zea mays
  misc_feature 1..1341: note = Ceres Clone ID no. 100861631
  misc_feature 1..1341: note = Encodes the peptide sequence at SEQ ID NO. 402
  source 1..1341: mol_type = other DNA
aatccgcagctcgccgttggacaagtgaggaaaggagagagaaagagaaagagagagagagagacggtcagccatggcggcgaaggcaagggtctcgctgacggctgtgctcgccgccgcggcgtgggcgtgcttatctgtcgtggccgcctccgcattcgacgtcccgaccgtggccttcgaggaggggttctcgccgctgttcggcgacggcaacctcgtccgctcctccgacgacaggagcgtccgcctcctgctcgaccgccggtccggttccgggttcatttcttcggactactacctccatggcttcttcagcgcgtccatcaagctgcccaaggactacacggccggcgtcgtcgtcgccttctacctgtctaacggggacgtgtacgagaagacgcacgacgagctggatttcgagttcctgggaagccggtggggcgggcagtggcgcgtgcagaccaacgtctacggcaatggcagcactagccgcggccgggaggagcgctacctcctccccttcgaccccaccgtcgaggcccacagctactccatcctctgggctcccacccacatcatcttctacgtcgacgacacgccgatccgggaggtgatccggcacccggacatgggcggcgacttcccggcgaagccgatggcggtgtacgccaccatctgggacggctccgcgtgggccacggacgggggcaagtacaaggtcaactacaagtacgcgccgttcgcgtccgacttctcggagctggccgtcgtcggctcccgcgccgacccggtgctccgcgtcccgcgccgggacggcgccgcccaccaggacctcctcgcgctcatgacggccgactacgccgtcgtgacgccgcggaagcgcgcggccatgcgcgcgttcagggcgcggcagatgacgtacacggtgtgctacgacgccgtgcggtacgcggacgggccgttccccgagtgcgacaactcggacgaggagagggagtccttctcggcctggggcgagtccaagaccgtcgtcatgaggccacgcgcccggggccgccgccggggacgcaaggccggcaggggacgggctggcgtgtcaagcagctgacatccttcaaaataatataaatgccagggtctgtcgcgaaagctattggcacaatggttagggatgatggtcgattggtccggtaacgtagtaggtcgattcgttttttatttttatattttttggcgacccatatgcaggctgtaaagctaggtgtagggacggagtactagcagggattaatgcgttatgattctttgattccttgggtggcagctaataaaatgctc

SEQ ID NO: 402 - protein, 345 aa, Zea mays
  REGION 1..345: note = Ceres Clone ID no. 100861631
  REGION 36..221: note = Pfam Name: Glyco_hydro_16 Pfam Description: Glycosyl hydrolases family 16
  REGION 253..301: note = Pfam Name: XET_C Pfam Description: Xyloglucan endo-transglycosylase (XET)
  REGION 1..345: note = Bit score of 537.0 for HMM based on sequences of Figure 5
  REGION 1..345: note = Functional Homolog Of SEQ ID NO. 348
MAAKARVSLTAVLAAAAWACLSVVAASAFDVPTVAFEEGFSPLFGDGNLVRSSDDRSVRLLLDRRSGSGFISSDYYLHGFFSASIKLPKDYTAGVVVAFYLSNGDVYEKTHDELDFEFLGSRWGGQWRVQTNVYGNGSTSRGREERYLLPFDPTVEAHSYSILWAPTHIIFYVDDTPIREVIRHPDMGGDFPAKPMAVYATIWDGSAWATDGGKYKVNYKYAPFASDFSELAVVGSRADPVLRVPRRDGAAHQDLLALMTADYAVVTPRKRAAMRAFRARQMTYTVCYDAVRYADGPFPECDNSDEERESFSAWGESKTVVMRPRARGRRRGRKAGRGRAGVSSS

SEQ ID NO: 403 - DNA, 1116 bp, Sorghum bicolor
  misc_feature 1..1116: note = Ceres Annot ID no. 8671232
  misc_feature 1..1116: note = Encodes the peptide sequence at SEQ ID NO. 404
  source 1..1116: mol_type = other DNA
atgggccgcctgacgccgccgccgtcggaggcggcggcggtggcgccgctgctcctcgtcgtcgtccacgtcctcctcctggcggccgccgtttccgcgctcccggcgatcaacgtgacgacgatggcgttcgaggacgggtacgctccgctgttcggccacggcaacatcctccgctccgccgaccaccgcaccgtcagcctcctcctcgaccgctccaccgggtctggtttcatctcctcgtccatgtaccagcacggcttcttcagcgcctccatcaagctcccctccgactacaccgccggcgtcgtcgtcgccttctacgcgtcgaacggcgacgtgttcgagaagcggcacgacgagctggacttcgagttcctcggcaacatccgggggaagccatggcgggtgcagacgaacgtgtacggcaacggcagcgtggggcggggccgcgaggagcggtacgtgctgccgttcgacccgaccacggagttccaccgctactccatcctgtggacgcccgccgccgtggcgttctacgtcgacgacgtgccggtgcgagaggtccgccggtccgacgccatgggcggggacttcccgtccaagcccatgtccgtctacgccaccgtctgggacgcctccacctgggccacctccggcggccgctaccgcgtcaactacaggtacgggcccttcgtcgcgtccttcaccgacctcgccctcctcggctgccgcgtcgacgggcccgtcgccgccatccagcaggtgctgctgccgccggtgccaagccggtgcgccgccgacgaggagaagctcagggcgtcggacgtggccgtcatgaccgtggagaagcagcaggccatgcgcaggttccgggagcggaacatggtctactcctactgctacgacacgctgcggtaccccgccgcgttcccagagtgcgacgtcgtcgagtcggagcgccgccggttcaaggatagtggacacctccgcttcgcgttccggcggcggatgggcccgcgacgctccggcggaagggcggccagcagagccgccgccgccgccgccagcagggacagggacagggacctcaagaagcgcgcggcggacatgtag

SEQ ID NO: 404 - protein, 371 aa, Sorghum bicolor
  REGION 1..371: note = Ceres Annot ID no. 8671232
  REGION 44..229: note = Pfam Name: Glyco_hydro_16 Pfam Description: Glycosyl hydrolases family 16
  REGION 265..314: note = Pfam Name: XET_C Pfam Description: Xyloglucan endo-transglycosylase (XET)
  REGION 1..371: note = Bit score of 582.7 for HMM based on sequences of Figure 5
  REGION 1..371: note = Functional Homolog Of SEQ ID NO. 348
MGRLTPPPSEAAAVAPLLLVVVHVLLLAAAVSALPAINVTTMAFEDGYAPLFGHGNILRSADHRTVSLLLDRSTGSGFISSSMYQHGFFSASIKLPSDYTAGVVVAFYASNGDVFEKRHDELDFEFLGNIRGKPWRVQTNVYGNGSVGRGREERYVLPFDPTTEFHRYSILWTPAAVAFYVDDVPVREVRRSDAMGGDFPSKPMSVYATVWDASTWATSGGRYRVNYRYGPFVASFTDLALLGCRVDGPVAAIQQVLLPPVPSRCAADEEKLRASDVAVMTVEKQQAMRRFRERNMVYSYCYDTLRYPAAFPECDVVESERRRFKDSGHLRFAFRRRMGPRRSGGRAASRAAAAAASRDRDRDLKKRAADM

SEQ ID NO: 405 - DNA, 1334 bp, Panicum virgatum
  misc_feature 1..1334: note = Ceres Clone ID no. 1813525
  misc_feature 1..1334: note = Encodes the peptide sequence at SEQ ID NO. 406
  source 1..1334: mol_type = other DNA
aggccaagaaacgcgtcagagtttggctcttgatcggacgccgccggtgcaagaggcagtgagaggagaaagagagagagagagaagaggcggcggaggaagaggaaggaggaggaggaggaggtgaggtcaggggccgagagggagccagccgctatacggccagccatggcggccagggccgggttcttgctcgccgccgcggcgtgggtgtgcctatcggctgtgtccgcctccgccttcgacgacgtgccgaccgcagccttcgacgagcggttctcgtcgctgttcggcgacggcaacctcgtccgctcctccgacgacaggagcgtccgcctcctgctcgaccgccgctccggttccgggttcatgtcctcggactactacctccacggcttcttcagcgcctccatcaagctgcccaaggactacacggccggcgtcgtcgtcgccttctacctgtcgaacggggacgtgtacgagaagacgcacgacgagctggacttcgagttcctgggcagccggtggggcggccagtggcgcgtgcagaccaacgtctacggcaacggcagcaccagccgcgggcgcgaggagcgctacctcctccccttcgaccccaccctcgaggcccaccgctactccgtcctctgggctcccacccacatcatcttctacatcgatgacacgccgatccgggaggtgatccggcacccggacatgggcggcgacttcccggcgaagccgatggcggtgtacgccaccatctgggacggctccgcgtgggccacggaggggggcaagtacaaggtcaactacaagtacgcgccgttcgcgtccgagttctcggacctcgccgtcgtcggcccccgcgccgacccggtgctccgcgttccccgccgcggcggcgcgggtgaccaggacgacgaccaggacctgctggggctcatgacggccgactacgccgtcatgacgccgcagaagcgcgccgccatgcgcgcgttcagggcgcggcacatgacgtacaccgtgtgctacgacgccgcgcggtacgcgtcgggccccttcccggagtgcgacaactcggacgaggagcgcgagaacttctccgcctggggcgagtccaagaccgtcgtcatgaggcctcgcgcccgtggccgccgccgggggcgcaaggccggcggcgccgccgccgccaggggacgcgcggcaagcagctgagatcagaagcaatcaggaatagatcgggttgcgaaagctattggcacaatggttgcagatgatcaattgatccgggactgtaattcgatctacctttttggggtgtccgttgcaga

SEQ ID NO: 406 - protein, 349 aa, Panicum virgatum
  REGION 1..349: note = Ceres Clone ID no. 1813525
  REGION 33..218: note = Pfam Name: Glyco_hydro_16 Pfam Description: Glycosyl hydrolases family 16
  REGION 258..302: note = Pfam Name: XET_C Pfam Description: Xyloglucan endo-transglycosylase (XET)
  REGION 1..349: note = Bit score of 529.4 for HMM based on sequences of Figure 5
  REGION 1..349: note = Functional Homolog Of SEQ ID NO. 348
MAARAGFLLAAAAWVCLSAVSASAFDDVPTAAFDERFSSLFGDGNLVRSSDDRSVRLLLDRRSGSGFMSSDYYLHGFFSASIKLPKDYTAGVVVAFYLSNGDVYEKTHDELDFEFLGSRWGGQWRVQTNVYGNGSTSRGREERYLLPFDPTLEAHRYSVLWAPTHIIFYIDDTPIREVIRHPDMGGDFPAKPMAVYATIWDGSAWATEGGKYKVNYKYAPFASEFSDLAVVGPRADPVLRVPRRGGAGDQDDDQDLLGLMTADYAVMTPQKRAAMRAFRARHMTYTVCYDAARYASGPFPECDNSDEERENFSAWGESKTVVMRPRARGRRRGRKAGGAAAARGRAASS

SEQ ID NO: 407 - protein, 343 aa, Arabidopsis thaliana
  REGION 1..343: note = Public GI ID no. 15222593
  REGION 32..217: note = Pfam Name: Glyco_hydro_16 Pfam Description: Glycosyl hydrolases family 16
  REGION 244..293: note = Pfam Name: XET_C Pfam Description: Xyloglucan endo-transglycosylase (XET)
  REGION 1..343: note = Bit score of 603.6 for HMM based on sequences of Figure 5
  REGION 1..343: note = Functional Homolog Of SEQ ID NO. 348
MSKSSYNHIFILILCLCLRSSSAFTNLNTLSFEESLSPLFGDANLVRSPDDLSVRLLLDRYTGSGFISSNMYQHGFYSSMIKLPADYTAGVVVAFYTSNGDVFEKTHDELDIEFLGNIKGKPWRFQTNLYGNGSTHRGREERYRLWFDPSKEFHRYSILWTPHKIIFWVDDVPIREVIRNDAMGADYPAKPMALYATIWDASDWATSGGKYKANYKFAPFVAEFKSFSLDGCSVDPIQEVPMDCSDSVDFLESQDYSSINSHQRAAMRRFRQRFMYYSYCYDTLRYPEPLPECVIVPAEKDRFKETGRLKFGGTEARERRRNRRQQRRPEIEIESDPDDRKLL

SEQ ID NO: 408 - protein, 337 aa, Solanum lycopersicum
  REGION 1..337: note = Public GI ID no. 42795460
  REGION 27..212: note = Pfam Name: Glyco_hydro_16 Pfam Description: Glycosyl hydrolases family 16
  REGION 241..290: note = Pfam Name: XET_C Pfam Description: Xyloglucan endo-transglycosylase (XET)
  REGION 1..337: note = Bit score of 617.8 for HMM based on sequences of Figure 5
  REGION 1..337: note = Functional Homolog Of SEQ ID NO. 348
MKICLSVLFFFHVWFCRAFNDVSTIPFNKGFSHLFGDGNILHANDDNSLQLHLNQNTGSGFKSSDLYNHGFFSAKIKLPSDYTAGIVVAFYTTNQDVFKKTHDELDFEFLGNIKGKAWRFQTNMYGNGSTHRGREERYTLWFDPSKEFHRYSILWTNKNIIFYIDDVPIREIVRNDAMGGDYPSKPMGLYATIWDASDWATSGGKYKTNYKYAPFIAEFTDLVLNGCAMDPLEQVVNPSLCDEKDVELQKSDFSRITSRQRMSMKRFRAKYMYYSYCYDSLRYSVPPPECEIDPVEQQHFKETGRLKFINKHHGHRHPKKTKSEVLDARKYGNEDEE

SEQ ID NO: 409 - DNA, 1226 bp, Panicum virgatum
  misc_feature 1..1226: note = Ceres Clone ID no. 1828819
  misc_feature 1..1226: note = Encodes the peptide sequence at SEQ ID NO. 410
  source 1..1226: mol_type = other DNA
atacggcgacgcaggcaccggtaggtactgcaggtaggggcaggtagcagccatggaagctggtgctgcgggtctgctgcttgctgcgctgatggtggtggtcggctggccggcggcggcggcgtcgctggacacgtcgccggtgccgttccaagccgggtacatgccgctgttcggcggcgacaaccttgtccggtcgcccggcggccgctccgtccgcctgaaactcgatcgccgcaccggctccgggttcgtatccaagtcggcgtaccaccatggatacttcagcgcctccatcaagctgcccgacgaccacaccgccggcgtcgtcgtcgccttctacctgtcgaacgccgacgtgtacccccgcaaccacgacgaggtggacttcgagctgctgggcaaccggcggggccacgagtggcgcgtccagaccaacgtctacggcaacggcagcacctcccgcggccgcgaggagcgctacctcctccccttcgaccccaccctccgcccgcacgcctacgccgtcgcctggacccccaccgccgtcgtcttctacgtcgacggggcgcccatccgcgaggtggtccgcgcgccggccatgggcggtgacttcccctccaagcccatgtccgtctacgccaccatctgggacggctccgcctgggccaccgagggtggacgctacaaggtcgactacgcccacgcgcccttcgccgccgacttctcgcggctcgtcctcgccggctgtccccccgccggcggcggcgcgaggtgcgcggtggcggtgataacggcggagttcgcggtgatgacccccgccaaacgcgccgccatgcgccggttccggcggcggcacctcctctacaccgtgtgccacgaccggtaccggtacaacggcaccgtcttccccgagtgcgacgacgccgagcgcgacgactttcacaagtggggcgagtccaagcgcgtgtcgccgggccgccgcgggtacaggcggcagcagcagccgcgcgcggacaaggccgccgccggcggccggcccagcacgtggccgacgatcggaaccctacgtgcagactagctagtaattttaagtgacggtcgatgtgtgtggtgcgtgccattaggagattgctgatgaattagttatatagcactgtatgtgtgcaggtgtttcttactctgcattttcaaggtgcagaaacatacagtcggtacatactgtc

SEQ ID NO: 410 - protein, 342 aa, Panicum virgatum
  REGION 1..342: note = Ceres Clone ID no. 1828819
  REGION 33..218: note = Pfam Name: Glyco_hydro_16 Pfam Description: Glycosyl hydrolases family 16
  REGION 242..289: note = Pfam Name: XET_C Pfam Description: Xyloglucan endo-transglycosylase (XET)
  REGION 1..342: note = Bit score of 516.5 for HMM based on sequences of Figure 5
  REGION 1..342: note = Functional Homolog Of SEQ ID NO. 348
MEAGAAGLLLAALMVVVGWPAAAASLDTSPVPFQAGYMPLFGGDNLVRSPGGRSVRLKLDRRTGSGFVSKSAYHHGYFSASIKLPDDHTAGVVVAFYLSNADVYPRNHDEVDFELLGNRRGHEWRVQTNVYGNGSTSRGREERYLLPFDPTLRPHAYAVAWTPTAVVFYVDGAPIREVVRAPAMGGDFPSKPMSVYATIWDGSAWATEGGRYKVDYAHAPFAADFSRLVLAGCPPAGGGARCAVAVITAEFAVMTPAKRAAMRRFRRRHLLYTVCHDRYRYNGTVFPECDDAERDDFHKWGESKRVSPGRRGYRRQQQPRADKAAAGGRPSTWPTIGTLRAD

SEQ ID NO: 411 - DNA, 870 bp, Populus balsamifera
  misc_feature 1..870: note = Ceres Annot ID no. 1460297
  misc_feature 1..870: note = Encodes the peptide sequence at SEQ ID NO. 412
  source 1..870: mol_type = other DNA
atggccttcatcccttcttgtgttcttgggttctcatcacatggtttacctacttcatcgttcaatgaatcattcattcgtttatttgggaatgatcatgtgatttttcttgacgatgaacgaaaatcagttcaaatttcccttgatcaaagttcaggttctggttttgcgtcacaactcacgtatctctattcatatttcagtgcttccatcaaattaccaggaaattacaccgctggagttgttgtctcttattacacatcaaatgctgatgagcacacaactaatcacgatgaaattgattttgagttcttgggaaatactggaggcaaaccttggaccctccaaaccaatttatatggcaatggaagtacaggtaggggacgtgaagagaggtacactctttggtttgatcctactcaagatttccattcgtatagtattctttggaccagtacatggatcgtttactacgtggatgatgttcctgttagagaggttcaaaagattgatgccatgggtggagattttccctctaaggctatgaatttatttgctacagtatgggatggatctagctgggcaacaggtggaggccaaaacaaggttgattataaatatgctcctttcattgctaaatattccagttttgtgctgtatggatgctctgccaacccagcccgagaagagtcagctgctgaaacgtgtggtaatgccacagatttgaattctttcaatggtttgacagctgagagaaaggggaaaatggagaaatttaggattgaacatttgatttattcttattgcaatgatcgttctcgatacccaactccattgcctgagtgtaatttaagaggaaaatctagttga

SEQ ID NO: 412 - protein, 289 aa, Populus trichocarpa
  REGION 1..289: note = Ceres Annot ID no. 1460297
  REGION 21..207: note = Pfam Name: Glyco_hydro_16 Pfam Description: Glycosyl hydrolases family 16
  REGION 236..282: note = Pfam Name: XET_C Pfam Description: Xyloglucan endo-transglycosylase (XET)
  REGION 1..289: note = Bit score of 438.1 for HMM based on sequences of Figure 5
  REGION 1..289: note = Functional Homolog Of SEQ ID NO. 348
MAFIPSCVLGFSSHGLPTSSFNESFIRLFGNDHVIFLDDERKSVQISLDQSSGSGFASQLTYLYSYFSASIKLPGNYTAGVVVSYYTSNADEHTTNHDEIDFEFLGNTGGKPWTLQTNLYGNGSTGRGREERYTLWFDPTQDFHSYSILWTSTWIVYYVDDVPVREVQKIDAMGGDFPSKAMNLFATVWDGSSWATGGGQNKVDYKYAPFIAKYSSFVLYGCSANPAREESAAETCGNATDLNSFNGLTAERKGKMEKFRIEHLIYSYCNDRSRYPTPLPECNLRGKSS

SEQ ID NO: 413 - protein, 313 aa, Vitis vinifera
  REGION 1..313: note = Public GI ID no. 225424689
  REGION 46..231: note = Pfam Name: Glyco_hydro_16 Pfam Description: Glycosyl hydrolases family 16
  REGION 257..310: note = Pfam Name: XET_C Pfam Description: Xyloglucan endo-transglycosylase (XET)
  REGION 1..313: note = Bit score of 387.7 for HMM based on sequences of Figure 5
  REGION 1..313: note = Functional Homolog Of SEQ ID NO. 348
MALLQQKLLASLLVIFGISAAVSAGNGHDAAPNVTRLTDLFGHLTFNHGFTEFFGGSNIQPINNGSYANLILNKSSGSGLVSQSKYYYGFFSAAIKLPSGYTSGVVVAFYMSNADLFPHNHDEIDIELLGHEKRKDWVLQTNMYGNGSVSTGREEKFRLWFDPTEQYHHYSFIWNRHHIVFLVDNVPVREILYNDAISSVYPSKPMSVYATIWDGSEWATHGGKYPVDYKYAPFVVSFGEMEMDGCTFDPKKKGVSCSKGSVSSRDPVDGEEFAKLSEQQRMGMEWARKKLMFYSYCKDSSRFKVLPPECKAK

SEQ ID NO: 414 - protein, 307 aa, Apium graveolens
  REGION 1..307: note = Public GI ID no. 76786474
  REGION 41..226: note = Pfam Name: Glyco_hydro_16 Pfam Description: Glycosyl hydrolases family 16
  REGION 252..304: note = Pfam Name: XET_C Pfam Description: Xyloglucan endo-transglycosylase (XET)
  REGION 1..307: note = Bit score of 393.8 for HMM based on sequences of Figure 5
  REGION 1..307: note = Functional Homolog Of SEQ ID NO. 348
MRSFLLVLFICSSIVAVSSRGPIYKPPPVERLTDRFVQQSVDKAFSNLYGNKNIHQLNNGSSVNIILDKSSGSGLISKNRYYYGFFSAAIKLPASFTSGVVVAFYLSNSDMYPHNHDEIDFELLGHEKRRDWVLQTNIYGNGSTKTGREEKFYLWFDPTIESHQYSILWNNHHTVFLVDNVPVREVVHNAAIASAYPSKPMSVYATIWDASEWATHGGKYAVNYKYAPFVASLGQIEMGGCIKQRADSTQSCVTGPSTLDPVEGQEFAKLSKQQTTGMDWARRKHMFYSYCKDTSRYKVLPAECNKA

SEQ ID NO: 415 - DNA, 1576 bp, Panicum virgatum
  misc_feature 1..1576: note = Ceres Clone ID no. 1804732
  misc_feature 1..1576: note = Encodes the peptide sequence at SEQ ID NO. 416
  source 1..1576: mol_type = other DNA
aaccaaatgcggcgtcctgctggtgtggtctagcgagccgcgtggtgcttgggctccgttcgttccgttgaggctcgcgtcgatctagcgatggagccccggtgctccgtgatggtcctggccctcgccgccgcgctatccgtcgcagtggcttacgacccgctggacccgaacgggaacattaccatcaaatgggacatcatgtcgtggacgcctgacggctatgtcgcggtggtgacgatcaacaacttccagatgtaccggcagatcatggcgccggggtggacggtggggtggacgtgggccaagaaggaggtgatctggtccatggtgggcgcgcaggccacggagcagggcgactgctcccgcttcaagggcaacatcccgcactgctgcaagcgcacccccgccgtcgtggacctgctgcccggcgtgccctacaaccagcagatcgccaactgctgccggggcggcgtcatcagcgcctacggccaggaccccggcgccgccgtcgccgcgttccaggtcagcgtcggccaggccggcaccaccaaccgcaccgtcaaggtgcccaagaacttcacgctgctcggccccggccctgggtacacctgcggccccgccaaggtcgtcccctccaccgtcttcctcacgcccgaccgccgccgcaagacccaggcactcatgacgtggaacgtgacgtgcacctactcgcagtacctggcgtccaagtacccgtcctgctgcgtctctttctcctccttctacaacgacaccatcgtgccctgcgccaagtgcgcctgcggctgcgagcacaagacctgcgtccagggcgactcgaagcggccgctggcggtgacggggaagcacacgcacgcggcggcgacgcgcgggcaccgggacaaggaggcgccgctgctgcagtgcacgacgcacatgtgccccgtgcgcgtgcactggcacgtcaagctcaactacaaggagtactggcgcgccaagatcgccatcaccaacttcaactaccgcatgaactacacgcagtggacgctcgtcgcgcagcaccccaacctcgacaacatcaccgaggtcttcagcttcgactacaagcccgtcgttgcctacggatccatcaatgacacggccatgttctacgggctcaagtacttcaacgaccacctcatgcaggcggggccgtacgggaacgtgcagtcggaggtgctcatgcgcaaggacgccagcaccttcaccttcaggcagggctgggcgttcccgcgcaaggtctacttcaacggcgatgagtgccagatgccgccgccggacgcctacccctacctgcccaacgccgccctgccggcccccgtggcgtcgctgggcgccgcggtggtggccgtcgtggcgttcctggtgctggtcgtggtatgagacatgagaaaaacacaggagagcgatcgacctagcgctagaatcggccggcatggggagaaaaagacgacgatgttttgctctgtagatacagtcgacgttttgacttttgagtttcaggattggtttggatatctaagtttttttttctttc

SEQ ID NO: 416 - protein, 443 aa, Panicum virgatum
  REGION 1..443: note = Ceres Clone ID no. 1804732
  REGION 1..443: note = Ceres Seed Line no. UAC-15
  REGION 45..209: note = Pfam Name: COBRA Pfam Description: COBRA-like protein
  REGION 1..443: note = Bit score of 1089.7 for HMM based on sequences of Figure 7
  REGION 1..443: note = Figure 7
MEPRCSVMVLALAAALSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKVVPSTVFLTPDRRRKTQALMTWNVTCTYSQYLASKYPSCCVSFSSFYNDTIVPCAKCACGCEHKTCVQGDSKRPLAVTGKHTHAAATRGHRDKEAPLLQCTTHMCPVRVHWHVKLNYKEYWRAKIAITNFNYRMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDAYPYLPNAALPAPVASLGAAVVAVVAFLVLVVV

SEQ ID NO: 417 - DNA, 1341 bp, Sorghum bicolor
  misc_feature 1..1341: note = Ceres Annot ID no. 8656625
  misc_feature 1..1341: note = Encodes the peptide sequence at SEQ ID NO. 418
  source 1..1341: mol_type = other DNA
atggagccccgatgcttcgtgctggtcctggccctcgccgccgcgctctccgtcgcagtggcttacgacccgttggacccgaacgggaacattaccatcaaatgggacatcatgtcgtggacgcctgacggctatgtcgcggtggtgaccatcaacaacttccagatgtaccggcagatcatggcgccggggtggacggtggggtggacgtgggcgaagcgtgaggtgatctggtccatggtgggcgcgcaggcgacggagcagggcgactgctcccgcttcaaggccaacatcccgcactgctgcaagcgcacgcccaccgtcgtcgacctgctccccggcgtgccctacaaccagcagatcgccaactgctgccgcggcggcgtcatcagcgcctacggccaggacccggcctccgccgtcgccgcgttccaggtcagcgtcggccaggccggcaccaccaaccgcaccgtcaaggttcccaagaacttcacgctgcttgggccagggccagggtacacctgcggccccggcaagattgttccctccaccgtcttcctcacgcccgaccgccggcgcaagacacaagccctcatgacgtggaacgtgacgtgcacctactcgcagcacctggcgtccaagtacccgtcctgctgcgtctccttctcctccttctacaacgacaccatcgtgccctgcgccaagtgcgcctgcggctgcgagcacaagacctgcgtccagggcgactcgaagcggctggcggtgacggggaagcacgagcacgcgcacgcggcggcggcgcgcgggcacagggacaaggaggcgccgctgctgcagtgcacgacgcacatgtgccccgtgcgcgtgcactggcacgtcaagctcaactacaaggagtactggcgggccaagatcgccatcaccaacttcaactaccacatgaactacacgcagtggacgctcgtcgcgcagcaccccaacctcgacaacatcaccgaggtcttcagcttcgactacaagcctgtcgtcgcctacggatccatcaatgacacggcgatgttctacgggctcaagtacttcaacgaccacctgatgcaggcggggccgtacgggaacgtgcagtcggaggtgctgatgcgcaaggacgccagcaccttcaccttcaggcagggctgggcgttcccgcgcaaggtctacttcaacggcgacgagtgccagatgccgccgccggacgagtatccctacttgcccaactcagccctgccggcagccgcggcgtcgtcgtcgctgggcgctgcggtagcggccgtcgtggtgctcttggtgatgatcgtggcatga

SEQ ID NO: 418 - protein, 446 aa, Sorghum bicolor
  REGION 1..446: note = Ceres Annot ID no. 8656625
  REGION 45..209: note = Pfam Name: COBRA Pfam Description: COBRA-like protein
  REGION 1..446: note = Bit score of 1091.4 for HMM based on sequences of Figure 7
  REGION 1..446: note = Functional Homolog Of SEQ ID NO. 416
  REGION 1..446: note = Figure 7
MEPRCFVLVLALAAALSVAVAYDPLDPNGNITIKWDIMSWTPDGYVAVVTINNFQMYRQIMAPGWTVGWTWAKREVIWSMVGAQATEQGDCSRFKANIPHCCKRTPTVVDLLPGVPYNQQIANCCRGGVISAYGQDPASAVAAFQVSVGQAGTTNRTVKVPKNFTLLGPGPGYTCGPGKIVPSTVFLTPDRRRKTQALMTWNVTCTYSQHLASKYPSCCVSFSSFYNDTIVPCAKCACGCEHKTCVQGDSKRLAVTGKHEHAHAAAARGHRDKEAPLLQCTTHMCPVRVHWHVKLNYKEYWRAKIAITNFNYHMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDEYPYLPNSALPAAAASSSLGAAVAAVVVLLVMIVA

SEQ ID NO: 419 - protein, 447 aa, Zea mays
  REGION 1..447: note = Public GI ID no. 162462515
  REGION 47..211: note = Pfam Name: COBRA Pfam Description: COBRA-like protein
  REGION 1..447: note = Bit score of 1081.2 for HMM based on sequences of Figure 7
  REGION 1..447: note = Functional Homolog Of SEQ ID NO. 416
  REGION 1..447: note = Figure 7
MEPRRSVLLLALAVAAALSVAVAYDPLDPNGNITIKWDIMSWTPDGYVAVVTINNFQTYRQITAPGWTVGWTWAKREVIWSMVGAQATEQGDCSRFKANIPHCCKRTPAVVDLLPGVPYNQQIANCCRGGVVSAYGQDPATAVAAFQVSVGQAGTTNRTVKVPKNFTLLGPGPGYTCGPGKVVPSTVFLTPDRRRKTQALMTWNVTCTYSQHLASKYPSCCVSFSSFYNDTIVPCAKCACGCEHKTCVQGDSKRLAVTGKHAHTAAAVRGQHRDKEAPLLQCTTHMCPVRVHWHVKLNYKEYWRAKIAITNFNYHMNYTQWTLVAQHPNLDNITEVFSFGYKPVVSYGSINDTAMFYGLKYFNDHLMQAGPYGNVQSEVLMRKDASTFTFRQGWAFPRKVYFNGDECQMPPPDAYPYLPNSAPPTAAASLGGAAAAAVVVLLGMIVA

SEQ ID NO: 420 - protein, 451 aa, Oryza sativa
  REGION 1..451: note = Public GI ID no. 75133694
  REGION 45..209: note = Pfam Name: COBRA Pfam Description: COBRA-like protein
  REGION 1..451: note = Bit score of 1060.3 for HMM based on sequences of Figure 7
  REGION 1..451: note = Functional Homolog Of SEQ ID NO. 416
  REGION 1..451: note = Figure 7
  source 1..451: note = Oryza sativa subsp. japonica
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALMTWNVTCTYSQHLASKYPSCCVSFSSFYNDTIVPCAKCACGCDAHKPCVRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 421 - DNA, 1540 bp, Triticum aestivum
  misc_feature 1..1540: note = Ceres Clone ID no. 829440
  misc_feature 1..1540: note = Encodes the peptide sequence at SEQ ID NO. 422
  source 1..1540: mol_type = other DNA
gtattctaattttcgccctttaatcagctccatcgatggagctccccaactctatgctcctggctctgttcctcgcgatcacctgctccgtcgcagctgcgtatgatccgctggacccgacgggcaacattacgatcaagtgggacatccagtcatggacgccggacgggtacgtggcgatggtggcgatgaacaactaccagcagtaccgtcagatcatggcgccggggtggacgctggggtggtcgtgggccaagaaggaggtgatctggtccatcgtgggcgcgcaggccacggagcagggcgactgctccaagttcaagggcggcatcccgcactgctgcaagcacacgccctccgtcgtcgacctcctccccggcgtgccctacaaccagcagatcgccaactgctgccgcggcggcgtcgtctccgcctacggccaggacccggccggcgcgctctcggcgttccaggtctccgtggggctcgccggcaccaccaacaagacggtgaagctgcccaaaaacttcacgctcatggggcccgggctcggctacacctgcggccccgccaccgtcgtcccctccaccgtgtactggagcgccgaccaccgccgcaagacgcaggcgctgatgacctggacggtgacctgcacctactcgcagcagctggcgtcgaggtacccgacgtgctgcgtctccttctcctccttctacaacagcacgatcgtgccgtgcgcccggtgcgcgtgcggctgcggcgcgcacaagagcacgggcgggcgcggcggcaagagccacagcgacgggtgcatcgccggcgactccaagcgcgcgctgacccccggggtgaacacgcccaagaaggacggggcgcagctgctgcagtgcaccaaccacatgtgccccatccgcgtgcactggcacgtcaagctcaactacaaggactactggcgcgccaagatcgccgtcaccaacttcaactaccgcatgaactacacgcagtggacgctcgtcgctcagcacccgaacctcaacaacgtcacggaggtcttcagcttccagtacaagccgctcctgccatacggcaacatcaacgacaccggcatgttctacggcctcaagctctacaacgacctgctcatggaggccggcccgttcggcaacgtgcagtcggaggtgctcatgcgcaaggacgacgccaccttcaccttcggtcagggatgggctttcccgcgcaagatctacttcaacggcgatgagtgcaagatgccgccgccggactcgtacccgtacctgcccaactccgcgccgccgcgttcttccatcatcaccgctgctgcctcaacgtgcctggtgttgctgctcctgctcctggcggcgtgatctatatatcctggtgccacaattttcccattttgtaaaagacaacgcactgttgtaggtaggggcattttggtcttgcgagtattttaccttgtacaccaagatggtatgttcaagtgatttcatggtaatccttaagggaaacgttaccttcc

SEQ ID NO: 422 - protein, 449 aa, Triticum aestivum
  REGION 1..449: note = Ceres Clone ID no. 829440
  REGION 46..210: note = Pfam Name: COBRA Pfam Description: COBRA-like protein
  REGION 1..449: note = Bit score of 1058.1 for HMM based on sequences of Figure 7
  REGION 1..449: note = Functional Homolog Of SEQ ID NO. 416
  REGION 1..449: note = Figure 7
MELPNSMLLALFLAITCSVAAAYDPLDPTGNITIKWDIQSWTPDGYVAMVAMNNYQQYRQIMAPGWTLGWSWAKKEVIWSIVGAQATEQGDCSKFKGGIPHCCKHTPSVVDLLPGVPYNQQIANCCRGGVVSAYGQDPAGALSAFQVSVGLAGTTNKTVKLPKNFTLMGPGLGYTCGPATVVPSTVYWSADHRRKTQALMTWTVTCTYSQQLASRYPTCCVSFSSFYNSTIVPCARCACGCGAHKSTGGRGGKSHSDGCIAGDSKRALTPGVNTPKKDGAQLLQCTNHMCPIRVHWHVKLNYKDYWRAKIAVTNFNYRMNYTQWTLVAQHPNLNNVTEVFSFQYKPLLPYGNINDTGMFYGLKLYNDLLMEAGPFGNVQSEVLMRKDDATFTFGQGWAFPRKIYFNGDECKMPPPDSYPYLPNSAPPRSSIITAAASTCLVLLLLLLAA

SEQ ID NO: 423 - protein, 453 aa, Populus trichocarpa
  REGION 1..453: note = Public GI ID no. 118488472
  REGION 64..228: note = Pfam Name: COBRA Pfam Description: COBRA-like protein
  REGION 1..453: note = Bit score of 1093.3 for HMM based on sequences of Figure 7
  REGION 1..453: note = Functional Homolog Of SEQ ID NO. 416
  REGION 1..453: note = Figure 7
MEFDKSAKDCYQSLQRSLLAEMKFIFLIALVFMIVPHAAAYDPLDPNGNITIKWDVMSWTPDGYVATVTMSNFQMYRHIISPGWTLSWSWAKKEVLWSMVGAQTTEQGDCSKFKGNIPHCCKKTPTVVDLLPGVPYNQQFSNCCKGGVMAAWGQDPTASVSAFQVSVGLAGTSNKTVKLPKNFTLLGPGPGYTCGPAKVVPSTVFLTPDRRRKTQALMTWNVTCTYSQFLASKNPTCCVSFSSFYNETITPCPTCACGCQNKNSCVKSNSKESHKKGINTPKKDNTPLLQCTHHMCPIRVHWHVKVNYRDYWRAKVAVTNFNYRMNYTEWTLVVQHPNLNNVTQVFSFDYKPLVPYESINDTGMFYGMKFYNDLLMEAGPFGNVQSEVLLQKDKNTFSLKQGWAFPRKVYFNGDECMLPPPDTYPYLPNSAYANPTSILSMAASLLLILLSMG

SEQ ID NO: 424 - protein, 440 aa, Cleome spinosa
  REGION 1..440: note = Public GI ID no. 90657534
  REGION 49..213: note = Pfam Name: COBRA Pfam Description: COBRA-like protein
  REGION 1..440: note = Bit score of 1101.1 for HMM based on sequences of Figure 7
  REGION 1..440: note = Functional Homolog Of SEQ ID NO. 416
  REGION 1..440: note = Figure 7
MRLSISGFFFFFFFFFSVFIYCTSAYDPLDPNGNVTIKWDVMSWTPDGYVAVVAMNNFQMYRHIPNPGWTLGWTWAKKEVIWSMVGAQTTEQGDCSKFKGNVPHCCKKTPTLVDLLPGVPYNQQFSNCCKGGVVAAWGQDPSASVSQFQVSVGLAGTSNKTVKLPKNFTLLGPGLGYTCGPAKIVPSTIFLTPDKRRKTQALMTWNVTCTYSQFLARKHPSCCVSFSSFYNDTITPCPSCACGCESKKGCVKSDSKILSVKGINTPRKDNAPLLQCTHHMCPVRVHWHVKVNYKDYWRVKIAVTNFNYRMNFSLWTLAIQHPNLNNVTQVFSFDYKPLVPYESINDTGMFYGMKYYNDLLMEAGPFGNVQSEVLLQKDRNTFTFKQGWAFPRKVYFNGDECMLPPPDTYPFLPNSAHGNLSSLWTLPLALLLLLLLISIW

SEQ ID NO: 425 - DNA, 1587 bp, Glycine max
  misc_feature 1..1587: note = Ceres Clone ID no. 1237946
  misc_feature 1..1587: note = Encodes the peptide sequence at SEQ ID NO. 426
  source 1..1587: mol_type = other DNA
aaaacttttgtcactgaaggtgtcttggagccaattgtagcagttggtaacatcaaacacatattcagacaatgaggcttgtcgtctcagctctttgtgttcttgtgttattctcttgtgcagttgcttatgatcctttggatccaaacggaaacgtaacaatcaaatgggatgtaatgtcttggacaccagatggctatgtggctgtggtaacaatgcacaacttccaaatgtttcggcacatcatgaatcctggatggaccttgggatggacatgggcaaagaaagaagtcatttggtccatgataggagctcaaaccacagaacaaggagattgctctaagttcaaaggcaacatacctcattgctgcaagaaaattcccacagttgtggaccttctccctggtgtaccttacaaccagcaattctcaaactgctgcaagggtggagtagtggcagcatggggccaagatccttcacaagctatctcttccttccaagtgagtgtaggccaagctggtacctcaaacaagacagttaaacttcccaagaacttcactctctttgctccaggaccaggctacacttgtggccctgcaaagattgttccttccaccaattttcttacgcctgacaagcgccgcaagactcaagcactaatgacatggaatgttacctgcacatactcacagtttctggcaagaaagaacccaagttgttgtgtatctttgtcatccttttacaatgaaaccattaccccttgtccctcttgtgcatgtggctgccagaacaagaagcattgtgtcaagggaaactccaaaattctcagcatggtgggggttcacactccaaagaaagacaatgaaccattgctgcagtgcactcatcacatgtgtccaatcagggtccactggcatgtgaagactaactataaggactattggcgagtcaaggttgccataacaaacttcaattacagaatgaatcactccctttggtctcttgctgttcagcatccaaatctcaacaatctcacacaagttttcagtttcaattacaagccacttcttccctatggatccataaatgatactggcatgttctatggcatgaagtacttcaatgatcttctaatggaagctggaccaactgggaatgttcaatcagagttgcttcttcagaaggacaaggatgcattcacattcaagcagggttgggcatttcctcgcaaggtttactttaatggtgatgaatgcatgctgccaccacctgacacctacccttttctccctaactctgctcctgcaagcctacttaacttccctgcgttcatgttgttattgttcttcttgcttgcagtttggtgaattggtgcatattgtgtcagaattttgtgaaatttttgaaaccatgtataccttcttaatggtaacgtgacaataggcatgaatactcaaattctttggaaacactaagccaaatctcatggctgtgttttatctgacatgtgagcaccaaaggggatgctaatatgtaaatctcaacagtgattttgtctgaatcatagattgatgatgctattactcc

SEQ ID NO: 426 - protein, 431 aa, Glycine max
  REGION 1..431: note = Ceres Clone ID no. 1237946
  REGION 43..207: note = Pfam Name: COBRA Pfam Description: COBRA-like protein
  REGION 1..431: note = Bit score of 1087.4 for HMM based on sequences of Figure 7
  REGION 1..431: note = Functional Homolog Of SEQ ID NO. 416
  REGION 1..431: note = Figure 7
MRLVVSALCVLVLFSCAVAYDPLDPNGNVTIKWDVMSWTPDGYVAVVTMHNFQMFRHIMNPGWTLGWTWAKKEVIWSMIGAQTTEQGDCSKFKGNIPHCCKKIPTVVDLLPGVPYNQQFSNCCKGGVVAAWGQDPSQAISSFQVSVGQAGTSNKTVKLPKNFTLFAPGPGYTCGPAKIVPSTNFLTPDKRRKTQALMTWNVTCTYSQFLARKNPSCCVSLSSFYNETITPCPSCACGCQNKKHCVKGNSKILSMVGVHTPKKDNEPLLQCTHHMCPIRVHWHVKTNYKDYWRVKVAITNFNYRMNHSLWSLAVQHPNLNNLTQVFSFNYKPLLPYGSINDTGMFYGMKYFNDLLMEAGPTGNVQSELLLQKDKDAFTFKQGWAFPRKVYFNGDECMLPPPDTYPFLPNSAPASLLNFPAFMLLLFFLLAVW

SEQ ID NO: 427 - protein, 462 aa, Vitis vinifera
  REGION 1..462: note = Public GI ID no. 225456557
  REGION 74..238: note = Pfam Name: COBRA Pfam Description: COBRA-like protein
  REGION 1..462: note = Bit score of 1091.5 for HMM based on sequences of Figure 7
  REGION 1..462: note = Functional Homolog Of SEQ ID NO. 416
  REGION 1..462: note = Figure 7
MEFNNSANPVHHTPFEAKDRCQWQDCYSFRELKHIFSVVIFFMMVSHAIAYDPLDPTGNITIKWDVVSWTPDGYVALVTMNNFQMYRHIMTPGWTLSWSWAKKEVIWSMVGAQTTEQGDCSKFKANIPHCCEKTPTVVDLLPGVPYNQQIANCCKAGVVAAWGQDPAGSVSSFQVSVGQAGTSNKTVKLPKNFTLLGPGPGYTCGPAKIVPSTIYLTPDHRRKTQAMMTWNVTCTYSQFLASKNPTCCVSFSSFYNDTMTPCPSCACGCRNKNMCISSDSKKLKALHNPKRSNTPLLQCTHHMCPIRVHWHVKLNYKDYWRVKIAITNFNYRMNYTQWTLVAQHPNLNNVTQVFSFDYKPLVPYESINDTGMFYGMKFYNDLLVEAGQHGNVQSEVLLQKNKDTFTFKQGWAFPRKVYFNGDECKLPPPDTYPFLPNSAHANPFAFWTMAAPLLLMILYTIW

SEQ ID NO: 428 - DNA, 1296 bp, Arabidopsis thaliana
  misc_feature 1..1296: note = Ceres Annot ID no. 1355066
  misc_feature 1..1296: note = Encodes the peptide sequence at SEQ ID NO. 429
  source 1..1296: mol_type = other DNA
atgaggctcctcttcagcttctgcttcttcttcttcatgatcatctttaccgcaactgcttatgatccattagatcctagtggtaacattacaatcaaatgggatattatgtcctggacggcagatggctatgtggctacggtaactatgaacaacttccaaatctaccggcacatacaaaaccctggttggacattaggttggacatgggcaaagaaagaggtgatttggtcaatggttggtgcacaaacaacagaacaaggagactgttccaagtttaagggaaatgtacctcattgctgtaagaaaacccctacagttgttgatctcttgccaggtgtgccttataatcaacagttctcaaactgttgcaaaggaggtgtaattggagcttggggtcaagatccatcagccgctgtatcccagtttcaggttagtgctggtttagctggaactacaaacaagactgtcaagcttcctaagaacttcactttgcttggtcccggccctggttacacttgcggtcctgccaaaatcgtgccctctaccgtttttctcacaactgacaaacggcgaaaaacacaagctttgatgacatggaatgttacctgcacatactcacagtttttagcaagaaagcatccaagctgttgtgtctccttctcttctttctacaacgacaccataactccttgcccgtcttgtgcctgtggctgcgagaacaaaaagagctgcgtcaaggctgattctaagattctaaccaagaaaggtctcaacacaccaaaaaaggacaacactcctttgttgcaatgcacacatcacatgtgccctgttagagtccactggcacgttaaaactaactacaaagactattggcgagtgaagatagcaatcacaaatttcaattaccggatgaatcatacactctggactttagcaattcagcatccaaatctcaacaatgtgactcaagttttcagctttgactacaaaccagtctctccttacggatccataaatgatactggaatgttctatggaacgaagttttacaatgatttattaatggaagctggaccttcagggaatgtgcaatcagaggttttgctacagaaagatcaaaagacttttactttcaagcaaggttgggcttttcctagaaaagtttactttaatggtgatgaatgtatgttacctccaccagattcatacccttttctaccaaactctgcacaagggaactttgcttcgttctcactcaccattcttcttctcctattcatctcaatatggtga

SEQ ID NO: 429 - protein, 431 aa, Arabidopsis thaliana
  REGION 1..431: note = Ceres Annot ID no. 1355066
  REGION 44..208: note = Pfam Name: COBRA Pfam Description: COBRA-like protein
  REGION 1..431: note = Bit score of 1083.3 for HMM based on sequences of Figure 7
  REGION 1..431: note = Functional Homolog Of SEQ ID NO. 416
  REGION 1..431: note = Figure 7
MRLLFSFCFFFFMIIFTATAYDPLDPSGNITIKWDIMSWTADGYVATVTMNNFQIYRHIQNPGWTLGWTWAKKEVIWSMVGAQTTEQGDCSKFKGNVPHCCKKTPTVVDLLPGVPYNQQFSNCCKGGVIGAWGQDPSAAVSQFQVSAGLAGTTNKTVKLPKNFTLLGPGPGYTCGPAKIVPSTVFLTTDKRRKTQALMTWNVTCTYSQFLARKHPSCCVSFSSFYNDTITPCPSCACGCENKKSCVKADSKILTKKGLNTPKKDNTPLLQCTHHMCPVRVHWHVKTNYKDYWRVKIAITNFNYRMNHTLWTLAIQHPNLNNVTQVFSFDYKPVSPYGSINDTGMFYGTKFYNDLLMEAGPSGNVQSEVLLQKDQKTFTFKQGWAFPRKVYFNGDECMLPPPDSYPFLPNSAQGNFASFSLTILLLLFISIW

SEQ ID NO: 430 - protein, 463 aa, Phaseolus vulgaris
  REGION 1..463: note = Public GI ID no. 38194917
  REGION 75..239: note = Pfam Name: COBRA Pfam Description: COBRA-like protein
  REGION 1..463: note = Bit score of 1081.1 for HMM based on sequences of Figure 7
  REGION 1..463: note = Functional Homolog Of SEQ ID NO. 416
  REGION 1..463: note = Figure 7
MRLVISAAVCVLVLFSYAGEITSTLYAEFASLSFTFHTRPTDFLMFLIVAAYDPLDPNGNVTIKWDVVSWTPDGYVAVVTMSNFQMFRHIMNPGWTLSWSWAKKEVIWSMVGAQTTEQGDCSKFKGNVPHCCKKTPTVVDLLPGVPYNQQFSNCCKGGVVAAWGQDPSSAVSSFQVSIGLAGTSNKTVKLPKNFTLLGPGPGYTCGPAKVVPSTVFLTADKRRKTQALMTWNVTCTYSQFLARKNPGCCVSLSSFYNETITPCPSCACGCQNKRNCIKSDSKRINMVGIHTPKKDNEPLLQCTHHMCPIRVHWHVKLNYMDYWRVKVAVTNFNYRMNYSLWTLAVQHPNLNNVTQVFSFDYKPILPYESINDTGMFYGMKYFNDLLMEAGPTGNVQSEILLQKDKDTFTLKQGWAFPRKVYFNGEECMLPPPDTYPILPNSAPVNLLNFTVFILTMLVMLALW

SEQ ID NO: 431 - protein, 458 aa, Picea sitchensis
  REGION 1..458: note = Public GI ID no. 116788824
  REGION 63..227: note = Pfam Name: COBRA Pfam Description: COBRA-like protein
  REGION 1..458: note = Bit score of 1046.5 for HMM based on sequences of Figure 7
  REGION 1..458: note = Functional Homolog Of SEQ ID NO. 416
  REGION 1..458: note = Figure 7
MGFSDTNTNMRVQSRWCFTSGILLGLTLIIAFAFSPTGAYDPLDPNGNITIKWDIMSWTPDGYLAVVTINNFQQYRHIQSPGWTLGWTWAKKEVIWSMVGAQTTEQGDCSKYKGNIPHCCNKNPTVVDLLPGTPYNQQIANCCKGGVIASWAQDPVNAVSAFQVSVGNAGTTNTTVRLPKNFTLKAPGPGYTCGPAKKVRASKFLTTDGRRVTQALMTWNITCTYSQFLAQKTPSCCVSLTSFYNDTIVPCPACTCGCQNNITQPGTCVESDSPVLPSLLNTSPKNLAPLIQCTPHMCPIKIHWHVKLNYKEYWRVKVTITNFNYRMNYTQWNIVVQHPNFDNVTQLFSFNYKPLTPYGKINDTAMLWGVKYYNDMLMQAGEMGNVQSELLFQKDKQTFTFKQGWGFPRRVYFNGDDCVLPPPDAYPWLPNGSPSPRVGKVFLLIVSLVVSACLLAFL

SEQ ID NO: 432 - DNA, 1877 bp, Gossypium hirsutum
  misc_feature 1..1877: note = Ceres Clone ID no. 1848658
  misc_feature 1..1877: note = Encodes the peptide sequence at SEQ ID NO. 433
  source 1..1877: mol_type = other DNA
aataaccgacagcttgcacccatatggatggagcatgtacctctctgtctcagactctgtactaaattgcttttataagcttcacttgcaactcaacagctgacctctctcttctccatttgatgtgagaaggatctttctttctttattctgcacatcttaaccttaaccacatcataagatagagatctcttaaacgatcgagttatggagactgtcttttcagcagcaagtagatccatttccaagctcattagcttcaccgctttgcttcttttcttgttttcctgctctactttcacttctactgaagcttatgatgcgcttgatccaactggcaatatcactatcaaatgggacgtaataagttggaccccagatggctatgttgctgttgttacaatgtacaatttccaacagtatcgccatattcaggcacctggttggacattggggtggacatgggccaaaaaggaagtaatctggagcatgatgggaagccaaaccacggaacaaggggattgttcaaaatacaaaggaaacgtccctcattgctgtaaaaaggatcccacagttgtggatttattgcctggaactccttataaccagcagattgcaaattgctgcaaaggcggtgtattaaattcatgggttcaagacccagccaatgcagcaagctcatttcaggttagtgtgggcgctgcaggaacaacgaacaaaactgtgagagtgcctagaaactttaccctgaaagcaccaggtccaggatatacttgtgggcctgccaagattgtgaaacccactaaattcataacggctgataaaaggagaataactcaagctatgatgacatggaatgttacatgcacatattcccaatttctggctcaaaagactcctacatgttgcgtctcgctctcttccttctataataacactatcgtgaattgcccgacatgtgcttgtggctgtcagaataactcaactgaatctgggagttgtgtaagcgaaaggtcttcacatttagcttcagctgttccgggcaaatctaccaatgcaccacctctgcttcagtgtacgagccatatgtgtccagttcgaattcactggcatgttaagctcaactacaaggaatactggcgtgtgaagatcacaatcaccaatttcaattacgcattgaactacagtcagtggaatctagttgtgcaacaccccaactttgacaatcttacacaacttttcagcttcaattacaaaccattaactccttatgctggcttaaatgatactgccatgttatggggacttaagttttataatgatttcctcaacgaagccggtcctcttgggaatgtgcagtcagaactattattcagaaaagatgcatcaacttttacttttgaaaagggatgggcttttccacggagaatatatttcaatggtgataactgtgtcatgccacctcccgatgcctacccttggttgccgaatactggtttgaagccagttatctctctgtttcagccagtcatgacgatcttggcatcatgtgttttcttatgggctaatatgtgatgaatgctgtctgcggaaaccgctaaaactatttgttcgacatcctgcaatttgcatctggtttcatattatcacactgaagcttttggtgatcgattcaatggtgttggaatagtttggtgcggcaatgtaacacgctaaagagtggatcaaggtgcacaatctctggtccctatagcatgtggtgtattatttatatgttggggtttgtaatttacaccatttccttttggagttaactgctttgttgtatgtttcattcacatcatacacatgatcgatttatttgtagaatatccttg

SEQ ID NO: 433 - protein, 455 aa, Gossypium hirsutum
  REGION 1..455: note = Ceres Clone ID no. 1848658
  REGION 60..224: note = Pfam Name: COBRA Pfam Description: COBRA-like protein
  REGION 1..455: note = Bit score of 1031.2 for HMM based on sequences of Figure 7
  REGION 1..455: note = Functional Homolog Of SEQ ID NO. 416
  REGION 1..455: note = Figure 7
METVFSAASRSISKLISFTALLLFLFSCSTFTSTEAYDALDPTGNITIKWDVISWTPDGYVAVVTMYNFQQYRHIQAPGWTLGWTWAKKEVIWSMMGSQTTEQGDCSKYKGNVPHCCKKDPTVVDLLPGTPYNQQIANCCKGGVLNSWVQDPANAASSFQVSVGAAGTTNKTVRVPRNFTLKAPGPGYTCGPAKIVKPTKFITADKRRITQAMMTWNVTCTYSQFLAQKTPTCCVSLSSFYNNTIVNCPTCACGCQNNSTESGSCVSERSSHLASAVPGKSTNAPPLLQCTSHMCPVRIHWHVKLNYKEYWRVKITITNFNYALNYSQWNLVVQHPNFDNLTQLFSFNYKPLTPYAGLNDTAMLWGLKFYNDFLNEAGPLGNVQSELLFRKDASTFTFEKGWAFPRRIYFNGDNCVMPPPDAYPWLPNTGLKPVISLFQPVMTILASCVFLWANM

SEQ ID NO: 434 - protein, 471 aa, Picea sitchensis
  REGION 1..471: note = Public GI ID no. 116790012
  REGION 69..234: note = Pfam Name: COBRA Pfam Description: COBRA-like protein
  REGION 1..471: note = Bit score of 1028.2 for HMM based on sequences of Figure 7
  REGION 1..471: note = Functional Homolog Of SEQ ID NO. 416
  REGION 1..471: note = Figure 7
MMEKRELNSSRGQRCMQNCHILNKNAAGFFLALTILAIAFSPAGAYDPLDPNGNITIKWDIVSWTADGYVAAVTMHNFQQYRHIPSPPGWTLGWNWAKKEVIWAVVGGQTTEQGDCSKWKAGSPHCCKKDPTVVDLLPGVPYNQQFTNCCKGGALASWAQDPPNSVASFQVSVGNSGTTNKTVKLPKNFTLKAPGPGYTCGPAKIVKSSLFFSTDRRRTTQALMTWNVTCTYSQFLAQKSSTCCVSLSSFYNDTITPCPTCACACRNNVTQPSCVHSDSPVLKLPGPTNPITNSLQPPLLQCTRHMCPVRVHWHVKLNYKDYWRVKITVTNFNYRMNYTDWTLVAQHPNFDNVTQVFSFNYKPLTPYGSINDTAMFWGQKYYNDLLMQAGPMGSVQSELLLRKDKQTFTFKQGWAFPRRLYFNGDQCVMPSPDAYPWLPSTAHPAPAPPSLFAFILPLALALAIVPSLFLP

SEQ ID NO: 435 - DNA, 1529 bp, Sorghum bicolor
  misc_feature 1..1529: note = Ceres Clone ID no. 570485
  misc_feature 1..1529: note = Encodes the peptide sequence at SEQ ID NO. 436
  source 1..1529: mol_type = other DNA
atctgcgccttctggtgagagtacgtgtgttggttgttcttgcaggcacttgcacgcgtggtcaccatggagctgccccacgccgcgctcgcgctgatcgtcgccgcggccgccacgctctccgtcgcagtggcctacgacccgctggatcccaacgggaacatcaccatcaaatgggacgttctctcgtggacgccagacggatacgtcgcgacggtgacgatcaacaacttccagacgtaccggcagatcatggcgccggggtggacggtggggtggacgtgggcgaagcgggaggtgatctggtccatggtgggcgcgcaggccacggagcagggcgactgctccaagttcaaggccaacctcccgcactcgtgcaagcgcacccccgccgtcgtcgacctgctcccgggcgtgccctacaaccagcagatcgccaactgctgccgcggcggcgtcgtctccgcctacggccaggacccgtccggcgccgtgtcctccttccaggtcagcgtcggccaggccggcaccaccaaccgcaccgtcaaggtccccaagaacttcaccctcctcggccccggcccaggctacacctgcggccccgccaaggtcgtcccctccaccgtcttcctcaccgccgaccaccgccgcaagacccaggccctcatgacgtggaacgtgacgtgcacctactcgcagcacctggcgtccaagtacccgacctgctgcgtctccttctcctccttctacaacgacaccatcgtgccctgcgccaagtgcgcgtgcggctgcgagcacaagacctgcgcccgcagcgagcgggactcgaagcggctcatgtcggcgtcggggaagagcagcgcgcacgcggtcaccgcggtgcgcgggcacgtgaaccggcagagcgcggcgccgctgctgcagtgcacgacccacatgtgccccgtgcgcgtccactggcacgtcaagctcaactaccacgactactggcgcgccaaggtgaccgtcaccaacttcaactaccgcaccaactacaccggctggacgctcgtcgcccagcaccccaacctcgacaacatcaccgaggtcttcagcttcgactacaagcccgtcgtctcctacggctccatcaatgatacggcgctgttctacgggatgaagttcttcaacgaccagctcatggaggcggggccgtacgggaacgtgcagtcggaggtgctgatgcgcaaggacgccagcacattcacgttcaggcaggggtgggcgttcccgcggaagatctacttcaacggcgacgagtgccggatgccgccgccggactcctacccttacctgcccaactccgcgccggcgtcgctcgtgagctccgcctccgtcgtcgtcgccttcttggttctactcatggcatgagcgtcggaggcggccatgatgttttgcctgtagatcataggagaacgttttgggcttcaaggttgagatcggtggtgttttaatctggatataattaaacgcaagtttttccccattac

SEQ ID NO: 436 - protein, 447 aa, Sorghum bicolor
  REGION 1..447: note = Ceres Clone ID no. 570485
  REGION 1..447: note = Ceres Peptide ID no. 22897927
  REGION 47..211: note = Pfam Name: COBRA Pfam Description: COBRA-like protein
  REGION 1..447: note = Bit score of 1057.8 for HMM based on sequences of Figure 7
  REGION 1..447: note = Functional Homolog Of SEQ ID NO. 416
MELPHAALALIVAAAATLSVAVAYDPLDPNGNITIKWDVLSWTPDGYVATVTINNFQTYRQIMAPGWTVGWTWAKREVIWSMVGAQATEQGDCSKFKANLPHSCKRTPAVVDLLPGVPYNQQIANCCRGGVVSAYGQDPSGAVSSFQVSVGQAGTTNRTVKVPKNFTLLGPGPGYTCGPAKVVPSTVFLTADHRRKTQALMTWNVTCTYSQHLASKYPTCCVSFSSFYNDTIVPCAKCACGCEHKTCARSERDSKRLMSASGKSSAHAVTAVRGHVNRQSAAPLLQCTTHMCPVRVHWHVKLNYHDYWRAKVTVTNFNYRTNYTGWTLVAQHPNLDNITEVFSFDYKPVVSYGSINDTALFYGMKFFNDQLMEAGPYGNVQSEVLMRKDASTFTFRQGWAFPRKIYFNGDECRMPPPDSYPYLPNSAPASLVSSASVVVAFLVLLMA

SEQ ID NO: 437 - protein, 499 aa, Oryza sativa
  REGION 1..499: note = Public GI ID no. 125559102
  REGION 45..231: note = Pfam Name: COBRA Pfam Description: COBRA-like protein
  REGION 1..499: note = Bit score of 1008.4 for HMM based on sequences of Figure 7
  REGION 1..499: note = Functional Homolog Of SEQ ID NO. 416
  source 1..499: note = Oryza sativa subsp. indica
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALSKLTTPSSSSPAPPLMMSCLCAVTWNVTCTYSQHLASKYPSCCVSFSSFYNDTIVPCAKCACGCDAHKPCVGTYARRAAAAAADDDELTAFSRRDVCRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 438 - DNA, 1846 bp, Panicum virgatum
  misc_feature 1..1846: note = Ceres Clone ID no. 1957107
  misc_feature 1..1846: note = Encodes the peptide sequence at SEQ ID NO. 439
  source 1..1846: mol_type = other DNA
acgcaacgcaaccaaccaggcgtcggccagggccgccagccagctgatcgacgcctgcaggtctctctggtggtgacgtgccatctcgatcgatcgattccctcctccttggccggccggccgcccggcctttatttgccggcctcgacgaccttcctctaggaacttgtgctaccagctagcagcagcagtcagtagcggtagtgttcttgctgcggacgcggccggccggctcgacgtccacgatgaggctccgcgactccgccgcgatggtggctctggtgctcgcgctcacctgctccgttgcagtgggctacgatcccctggaccccaacggcaacatcaccatcaagtgggatgtcatctcctggacgcccgacgggtacgtggccatggtgacgatgagcaactaccagatgtaccgccacatcatggcgcccgggtggacggtggggtggtcgtgggccaagaaggaggtgatctggtccatggtcggcgcgcaggccacggagcagggcgactgctccaagttcaaggccggcatcccgcactgctgcaagcgcacccccgccgtcgtcgacctcctcccgggcgtcccctacaaccagcagatcgccaactgctgcaaggccggcgtcgtcgccgcctacggccaggaccctgccgccgccgtctccgccttccaggtctccgtcggcctcgccggcaccaccaacaagacggtcaagctgcccaggaacttcaccctccagggccccggccccggctacacctgcggccccgcccggatcatcccctccaccgtctacctcacccccgaccgccgccgccggacgcaggcgctcatgacctgggcgctcacctgcacctactcgcagcagctcgcctccaagtacccctcctgctgcgtctccttctcctccttctacaacagcaccatcgtgccctgcgcccgctgcgcctgcggctgcggccacggcggccacggcgccgccggctgcatcgccggcgactccaagcgggcgctctcccccggcgtcaacacgccgcgcaaggacggccagccgctgctccagtgcacgccgcacatgtgcccggtgcgcgtccactggcacgtcaagctcaactacaaggactactggcgcgccaagatcgccatcaccaacttcaactaccggatcaactacacgcagtggacgctggtggcgcagcaccccaacctggacaacgtcaccgaggtcttcagcttccagtacaagccgctgctcccctacggcgccatcaacgacaccggcatgttctacgggctcaagttctacaacgacctgctcatggaggccgggcccttcggcaacgtgcagtccgaggtgctcatgcgcaaggacgcaagaaccttcaccttcagccagggctgggcgttcccgcggaagatctacttcaacggcgacgagtgcaagatgccgccgccggactcgtacccctacctgcccaactccgccccgctcgcggctccggtcatcgccaccgcggcctcggcgttcctgctggtggcgctgctcctggtggcgtgatcggtcatgggaattgggatgggctgccagggagcagagtaggcatggcgctctggagactgaaacgcttggcaatgtcatgtgtgttgttgcctgtgcagctgcacatagagagactagcagaccaatcaggctggcagagatcctggcacttttgagtctccaattactttttagacagcctgatcgagaacaaatgatagtatacatagtagagcacaaccttttttctgtggtttcgtcatgtacacataatgcagattattaattgttcg

SEQ ID NO: 439 - protein, 441 aa, Panicum virgatum
  REGION 1..441: note = Ceres Clone ID no. 1957107
  REGION 47..211: note = Pfam Name: COBRA Pfam Description: COBRA-like protein
  REGION 1..441: note = Bit score of 1049.2 for HMM based on sequences of Figure 7
  REGION 1..441: note = Functional Homolog Of SEQ ID NO. 416
MRLRDSAAMVALVLALTCSVAVGYDPLDPNGNITIKWDVISWTPDGYVAMVTMSNYQMYRHIMAPGWTVGWSWAKKEVIWSMVGAQATEQGDCSKFKAGIPHCCKRTPAVVDLLPGVPYNQQIANCCKAGVVAAYGQDPAAAVSAFQVSVGLAGTTNKTVKLPRNFTLQGPGPGYTCGPARIIPSTVYLTPDRRRRTQALMTWALTCTYSQQLASKYPSCCVSFSSFYNSTIVPCARCACGCGHGGHGAAGCIAGDSKRALSPGVNTPRKDGQPLLQCTPHMCPVRVHWHVKLNYKDYWRAKIAITNFNYRINYTQWTLVAQHPNLDNVTEVFSFQYKPLLPYGAINDTGMFYGLKFYNDLLMEAGPFGNVQSEVLMRKDARTFTFSQGWAFPRKIYFNGDECKMPPPDSYPYLPNSAPLAAPVIATAASAFLLVALLLVA

SEQ ID NO: 440 - DNA, 1566 bp, Panicum virgatum
  misc_feature 1..1566: note = Ceres Clone ID no. 1781794
  misc_feature 1..1566: note = Encodes the peptide sequence at SEQ ID NO. 441
  source 1..1566: mol_type = other DNA
caggaacttgtcccaccagctagcagtcagtagcggtgttcttgcagaggcggccggccggctcgacgtgcgtcgacgatggggctccgccgcgactccgccgccgcgctggtggctctggtgctcgcggtcacctgctgctccgttgcagtagtggcctacgatcccctggacccgaacggcaacatcaccatcaagtgggacgtcatctcctggacgcccgacggctacgtggcgatggtgacgatgagcaactaccagatgtaccggcacatcatggcgcccgggtggacggtggggtggtcgtgggccaagaaagaggtgatctggtccatcgtgggcgcgcaggccacggagcagggcgactgctccaagttcaaggccggcatcccgcactgctgcaagcgcacccccgccgtggtggacctcctcccgggcgtaccctacaaccagcagatcgccaactgctgcaaggccggcgtcgtcgccgcctacggccaggaccccaccgccgccgtctccgccttccaggtctccgtcggcctcgccggcaccaccaacaagaccgtcaagctccccaccaacttcaccctccagggccccggcccgggctacacctgcggccccgcccgcgtcgtcccctccaccgtctacctcacccccgaccgccgccgccgcacgcaggcgctcatgacctggaccgtcacctgcacctactcccagcagctcgcctcccggtacccctcctgctgcgtctccttctcctccttctacaacagcaccatcgtgccctgcgcccactgcgcctgcggctgcggccatggcggccacggcggcgccggctgcatcgccggcgactccaagcgcgcgctctcccccggcgtcaacacgccgcgcagggacgggcagccgctgctgcagtgcacgccgcacatgtgcccggtgcgcgtccactggcacgtcaagctcaactacaaagactactggcgcgccaagatcgccatcaccaacttcaactaccggatcaactacacgcagtggacgctggtggcgcagcaccccaacctggacaacgtcaccgaggtcttcagcttccagtacaggccgctgctgccctacggcgccatcaacgacaccggcatgttctacgggctcaaattctacaacgacctgctcatggaggccgggcctttcggcaacgtgcagtccgaggtgctcatgcgcaaggacgccagaaccttcaccttcagccagggatgggccttcccaaggaagatctacttcaacggcgacgagtgcaagatgccgccgccggactcctacccctacctgcccaacaggtccgcccgggttgcggcaccgtcggtgatcgcctcggcattcctgctggcgctgctgctcctgctggcgccgtgattgatagggagcagcagagtgtgttgttacctgtgcagcggtggtttcgtcatgtaaacataacgcggtgggatctccaattactttctagacagcctgagaacaaatgatagtaatacatagtagagcacaagcctttttctgcggttt

SEQ ID NO: 441 - protein, 445 aa, Panicum virgatum
  REGION 1..445: note = Ceres Clone ID no. 1781794
  REGION 51..215: note = Pfam Name: COBRA Pfam Description: COBRA-like protein
  REGION 1..445: note = Bit score of 1030.0 for HMM based on sequences of Figure 7
  REGION 1..445: note = Functional Homolog Of SEQ ID NO. 416
MGLRRDSAAALVALVLAVTCCSVAVVAYDPLDPNGNITIKWDVISWTPDGYVAMVTMSNYQMYRHIMAPGWTVGWSWAKKEVIWSIVGAQATEQGDCSKFKAGIPHCCKRTPAVVDLLPGVPYNQQIANCCKAGVVAAYGQDPTAAVSAFQVSVGLAGTTNKTVKLPTNFTLQGPGPGYTCGPARVVPSTVYLTPDRRRRTQALMTWTVTCTYSQQLASRYPSCCVSFSSFYNSTIVPCAHCACGCGHGGHGGAGCIAGDSKRALSPGVNTPRRDGQPLLQCTPHMCPVRVHWHVKLNYKDYWRAKIAITNFNYRINYTQWTLVAQHPNLDNVTEVFSFQYRPLLPYGAINDTGMFYGLKFYNDLLMEAGPFGNVQSEVLMRKDARTFTFSQGWAFPRKIYFNGDECKMPPPDSYPYLPNRSARVAAPSVIASAFLLALLLLLAP

SEQ ID NO: 442 - protein, 468 aa, Oryza sativa
  REGION 1..468: note = Public GI ID no. 115453531
  REGION 46..210: note = Pfam Name: COBRA Pfam Description: COBRA-like protein
  REGION 1..468: note = Bit score of 1041.9 for HMM based on sequences of Figure 7
  REGION 1..468: note = Functional Homolog Of SEQ ID NO. 416
  source 1..468: note = Oryza sativa subsp. japonica
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCARCACGCGHDGYRGNGGGGKNARAGDGRSRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 443 - DNA, 1684 bp, Zea mays
  misc_feature 1..1684: note = Ceres Clone ID no. 285169
  misc_feature 1..1684: note = Encodes the peptide sequence at SEQ ID NO. 444
  source 1..1684: mol_type = other DNA
attcgccctgcctctagctgctgcttcttccaggatcggggatcggagcttgtgctgctactgctactataccagcgctagctagcagcagccgccggccggctcgcgcaactaaggaagggtcgacatgacgatggggctccgcgtccgcgactcctccgcgctgctggctctggccgtcgcgctcgcctgctgctccgttgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggacgttggggtggtcgtgggccaagaaggaggtgatctggtccatcgtgggggcgcaggccacggagcagggggactgctccaagttcaagggcggcatcccgcactgctgcaagcgcaccccggccgtggtggacctcctcccgggggtgccctacaaccagcagatcgccaactgctgcaaggccggcgtggtgtcggcgtacgggcaggacccggcggggtccgtctccgcgttccaggtctccgtcggcctggccggtaccaccaacaagacggtgaagctgcccaggaacttcacgctcatggggcccgggctgggctacacctgcgggcccgccgccgtggtgccgtccaccgtgtactggacgcccgaccaccggcgccggacgcaggcgctcatgacgtggacggtgacctgcacctactcgcagcagctggcgtcccggtacccgtcctgctgcgtctccttctcctccttctacaacagcaccatcgtgccgtgcgcccggtgcgcgtgcggctgcggcggccacggcggccacgcgggtccgggcggctgcatcgagggggactccaagcgcgcgctgtcggccggggtgaacacgccgcgcaaggacggccaggcgctgctgcagtgcacgccgcacatgtgccccatccgggtgcactggcacgtcaagctcaactacaaggactactggcgcgccaagatcgccatcaccaactacaactacaggatgaactacacgcagtggacgctggtggcgcagcaccccaacctggacaacgtcaccgaggtcttcagcttccagtacaagccgctgcaaccatacgggagcatcaatgacactggcatgttctacgggctcaagttctacaacgactttctcatggaggccggcccgttcggcaacgtgcagtcggaggtgctcatgcgcaaggacgcaaggaccttcaccttcagcatgggctgggcgttcccgcgcaagatctacttcaacggcgacgagtgcaagatgccgccgccggactcctacccctacctgcccaacgccgcgcccgtcgtcgcctcgcagctggtcctgtccgccgccgcctcggcgttcctactgttgctgctcctggtggcatgaccgtgaccgaaccaagggcaaggcctccgttttgttttcccgtctcgtcccgtgggcagggagcagacttcagtaggcagggcattttatttggtttttttgccaaggattcaacacttgggttttcgtcagaggaaaactgtcgtgtatgtagtgtgagttgcaggtcgtcggatccccacgtacaagacaatctttggatcg

SEQ ID NO: 444 - protein, 450 aa, Zea mays
  REGION 1..450: note = Ceres Clone ID no. 285169
  REGION 53..217: note = Pfam Name: COBRA Pfam Description: COBRA-like protein
  REGION 1..450: note = Bit score of 1036.9 for HMM based on sequences of Figure 7
  REGION 1..450: note = Functional Homolog Of SEQ ID NO. 416
MTMGLRVRDSSALLALAVALACCSVAVVAYDPLDPNGNITIKWDVISWTPDGYVAMVTMSNYQMYRHIMAPGWTLGWSWAKKEVIWSIVGAQATEQGDCSKFKGGIPHCCKRTPAVVDLLPGVPYNQQIANCCKAGVVSAYGQDPAGSVSAFQVSVGLAGTTNKTVKLPRNFTLMGPGLGYTCGPAAVVPSTVYWTPDHRRRTQALMTWTVTCTYSQQLASRYPSCCVSFSSFYNSTIVPCARCACGCGGHGGHAGPGGCIEGDSKRALSAGVNTPRKDGQALLQCTPHMCPIRVHWHVKLNYKDYWRAKIAITNYNYRMNYTQWTLVAQHPNLDNVTEVFSFQYKPLQPYGSINDTGMFYGLKFYNDFLMEAGPFGNVQSEVLMRKDARTFTFSMGWAFPRKIYFNGDECKMPPPDSYPYLPNAAPVVASQLVLSAAASAFLLLLLLVA

SEQ ID NO: 445 - DNA, 1296 bp, Populus balsamifera
  misc_feature 1..1296: note = Ceres Annot ID no. 1450186
  misc_feature 1..1296: note = Encodes the peptide sequence at SEQ ID NO. 446
  source 1..1296: mol_type = other DNA
atgagatttctcttctttattgtcttgtttcttgtgctcttttcttgttcaggtgcatatgatcctttggatccaactggaaatgtaacaataaaatgggatattatgtcttggacgacagatggctatattgcaattgtaacattgttcaacttccaaacgttccggcacttcatgaaacctggatggaccataggctggacatgggcaaagaaagaaatcatatggtccatcaatggtgctcaagcggttgaacaaggcgactgctccaagttcaaagcaaacatacctcattcctgcaagagaagccctgcagttgtggacttgcttcccggtgctcctttcaaccagcaattcggtaattgttgcaaaggcggagtagtggcagcatggggcaaagatccttcagctgctgtctctcaatttcagattactgttggattatccggtacttcaaataaaacagtgaaacttccaaagagcttcaccttgttaggtccaggaccaggatacacttgtggccctccaaagatggtgccttccaccaagtttcttactcctgatggtctgcgaagaactcaggccctgttgacttggaatgttacctgcacttactcacaattcatggcaagaaaaaacccaagttgctgtgtatctctttcatctttctacaatcagatactcactccctgcccaacttgtgcgtgcggttgccaaaacaatgacacttgtgtcaatggcgattccagaattcttcaattgccggtaggaaacacaacccggaaagataatagctctcttctgcaatgcacacaccatatgtgcccggttcgagtgcactggcatgtgaaggtgaactataaggagtactggcgtgtcaagattgcgatcacaaatttcaactacatgaagaactactcgacttggaccctcgttgtacagcatccgaatctcaacaacgtaacgcaagtttttagcttcgagtacaaacctctcattgcctatgactcgataaatgacacagggatgttctatggcatgaaggactacaatgacgtattaatggaagcagggccacttggaaatcttcaatctgaggtgcttcttcagaaggaccagaacactttcaccttcaagcagggatgggcatttccacggaaagtctacttcaatggcgatgagtgcatggtacccccgccagatacatacccatttctgcccaattctgctcatggatccccacacttctccatgttgatttctacgttgattttcctgttcgtgtatatctggtaa

SEQ ID NO: 446 - protein, 431 aa, Populus trichocarpa
  REGION 1..431: note = Ceres Annot ID no. 1450186
  REGION 43..207: note = Pfam Name: COBRA Pfam Description: COBRA-like protein
  REGION 1..431: note = Bit score of 970.8 for HMM based on sequences of Figure 7
  REGION 1..431: note = Functional Homolog Of SEQ ID NO. 416
MRFLFFIVLFLVLFSCSGAYDPLDPTGNVTIKWDIMSWTTDGYIAIVTLFNFQTFRHFMKPGWTIGWTWAKKEIIWSINGAQAVEQGDCSKFKANIPHSCKRSPAVVDLLPGAPFNQQFGNCCKGGVVAAWGKDPSAAVSQFQITVGLSGTSNKTVKLPKSFTLLGPGPGYTCGPPKMVPSTKFLTPDGLRRTQALLTWNVTCTYSQFMARKNPSCCVSLSSFYNQILTPCPTCACGCQNNDTCVNGDSRILQLPVGNTTRKDNSSLLQCTHHMCPVRVHWHVKVNYKEYWRVKIAITNFNYMKNYSTWTLVVQHPNLNNVTQVFSFEYKPLIAYDSINDTGMFYGMKDYNDVLMEAGPLGNLQSEVLLQKDQNTFTFKQGWAFPRKVYFNGDECMVPPPDTYPFLPNSAHGSPHFSMLISTLIFLFVYIW

SEQ ID NO: 447 - DNA, 1823 bp, Panicum virgatum
  misc_feature 1..1823: note = Ceres Clone ID no. 1806851
  misc_feature 1..1823: note = Encodes the peptide sequence at SEQ ID NO. 448
  source 1..1823: mol_type = other DNA
ctcgcacccacaagaatagctcaaacccgcgtgcatgtctgcatccccgggcggacacggcgcgcgccagaagcctcgcatcgccatcgcgcatacaaactggcaggccagacaccacaggacgagagacagagaggaaacctctgcttctccctctgacccactcctcgttcttctgagctcctgttgccttcctccgcacggagagcagacacgccgagagcgatcagggcagggaggggtctgctgcttacttcctgagctctgccgggccgggccatggcgggacggcggacggcgcccctgcgcctgtgcgcctccgtcgcgctgctcgtcgtcgccgtctcctctctgacgccttcgtcagatgcatacgatccactcgatccgaatgggaacataacaatcaagtgggatgtaatgcagtggactccagatggctatgtggctgttgtttccctatacaattaccagcagtaccgccacatccaagcgccgggctggaaactcggatgggtttgggcaaagaaggagataatctgggcaatgaccggtggccaagccactgagcaaggcgattgctccaaattcaaaagcaacattccccattgctgcaagaaggatcctgaggttgtggacctgcttcctggcacaccttataacatgcagatcgccaactgctgcaagggaggagtcctcaccgcatgggcacaggaccctgacaatgctgtggcttcgttccaagtcagtgttggtcaggctgggacgaccaacaagactgtgaaggtgcccaagaatttcactctgaaggctcccgggccagggtatacctgcggccctgccaaactagtgaaacctactaagttcatatcgccggatgggagaagatcaactcaagcacacatgacttggaatgtgacctgtacatactcacagtttgttgcccaaagatctccaacctgctgtgtttcgctttcatcgttttacaacgacaccattgtcaactgcccaacatgctcttgtggatgccagaataacagcactgcaccaggaagctgtgtagagggtaattcaccttatctggcctctgtcgtgaacgatcctaacaagaacagcttggcacctctagtccaatgcacttctcacatgtgcccaataagagtgcattggcatgtcaaagtgaactacaaggagtactggagggtcaagatcaccgtgacaaacttcaactaccggatgaactactcgcagtggaacctcgttgcgcagcaccccaacttcgacaacctgactaccattttcagcttcaactacaaatctctgaacccctatggcgtaataaacgacaccgcgatgttatggggcatcaagtactacaacgatctgctgatgacggctgggccggacgggaatgttcagtctgagcttctgttccggaaggagccctccaccttcaccttccagaaaggctgggctttcccaagacgagtgtacttcaatggcgacaactgcgtgatgccgccgccggacgcgtacccatggctgcccaacgcctctccacggcagtcagcttcggttctcctcacatttgttgctgtttgggcagcattggcgatcctactggccaatccctagtgatgtagtacatgtttcacagaaagttttgacctgattgcattggatgctattgccttctgatcattgagtttcttgcgatggtgttcaaatgtacagttacgtactcaaggatgtacattcccgtacttgtaaattttagcaaagactgactggcgagaaataaagctgtttcctcggcatcatgc

SEQ ID NO: 448 - protein, 451 aa, Panicum virgatum
  REGION 1..451: note = Ceres Clone ID no. 1806851
  REGION 55..219: note = Pfam Name: COBRA Pfam Description: COBRA-like protein
  REGION 1..451: note = Bit score of 971.8 for HMM based on sequences of Figure 7
  REGION 1..451: note = Functional Homolog Of SEQ ID NO. 416
MAGRRTAPLRLCASVALLVVAVSSLTPSSDAYDPLDPNGNITIKWDVMQWTPDGYVAVVSLYNYQQYRHIQAPGWKLGWVWAKKEIIWAMTGGQATEQGDCSKFKSNIPHCCKKDPEVVDLLPGTPYNMQIANCCKGGVLTAWAQDPDNAVASFQVSVGQAGTTNKTVKVPKNFTLKAPGPGYTCGPAKLVKPTKFISPDGRRSTQAHMTWNVTCTYSQFVAQRSPTCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKSLNPYGVINDTAMLWGIKYYNDLLMTAGPDGNVQSELLFRKEPSTFTFQKGWAFPRRVYFNGDNCVMPPPDAYPWLPNASPRQSASVLLTFVAVWAALAILLANP

SEQ ID NO: 449 - protein, 448 aa, Phaseolus vulgaris
  REGION 1..448: note = Public GI ID no. 38194916
  REGION 53..217: note = Pfam Name: COBRA Pfam Description: COBRA-like protein
  REGION 1..448: note = Bit score of 1007.1 for HMM based on sequences of Figure 7
  REGION 1..448: note = Functional Homolog Of SEQ ID NO. 416
MGFSLLPKATPCILLLVLLYCTCFTSTDAYDPLDPNGNITIKWDIITWTPDGYVAVVTMNNFQQYRHIASPGWRLGWTWAKKEVIWSMMGGQTTEQGDCSKFKAGIPHCCKKDPTVVDLLPGTPYNQQIANCCKGGVLGSWVQDPTNAVSSFQVSVGRAGTTNKTVKVPKNFTLSAPGPGYTCGPAKIVKPTQFIQADKRRVTQALMTWNVTCQYSQFLAQKTPSCCVSLSSFYNDTIVPCPTCACGCQGNSSLSGSCVNSQTPHLASVVSGSGKNNLSPLVQCTSHMCPVRIHWHVKVNYKEYWRVKVTITNFNYRMNYSEWNMVVQHPNFDNLTQLFSFNYKSLTPYGSINDTAMLWGVKFYNDFLSQAGPNGNVQSELLFRKDKATFTFDKGWAFPRRIYFNGDNCVMPPPDAYPWLPNAGSRQEVSLFALVIAYLVALVFYAHA

SEQ ID NO: 450 - protein, 456 aa, Vitis vinifera
  REGION 1..456: note = Public GI ID no. 225451792
  REGION 60..224: note = Pfam Name: COBRA Pfam Description: COBRA-like protein
  REGION 1..456: note = Bit score of 1013.5 for HMM based on sequences of Figure 7
  REGION 1..456: note = Functional Homolog Of SEQ ID NO. 416
MGFCLSLISRSISSFCGCTILLLFLLSCSCFTSTEAYDALDPNGNITIKWDIMSWTPDGYVAVVTMYNFQQYRHIQSPGWSLQWTWAKKEVIWSMLGGQTTEQGDCSRFKGNVPHCCKKDPTVVDLLPGTPYNQQIANCCKGGVVSSWVQDPANAASSFQVSVGSAGTTNKTVRVPKNFTLKAPGPGYTCGPAKIVKPTRFVTQDGRRVTQALMTWNVTCTYSQFLSQKTPTCCVSLSSFYNDTIVPCPTCTCGCQNNITQPGSCVEEDSPYLASVVSGSGKNSYTPLVQCTKHMCPIRVHWHVKLSYKEYWRVKVTITNFNYRMNYTQWNLVVQHPNFDNLTQIFSFNYKSLTPYAAINDTAMLWGVKFYNDLLVQAGPLGNVQSELLFRKDKSTFTFEKGWAFPRRIYFNGDNCVMPPPDSYPWLPNATSRTSTSLLTLIMVLLSALLLLNAHV

SEQ ID NO: 451 - protein, 456 aa, Vitis vinifera
  REGION 1..456: note = Public GI ID no. 225456559
  REGION 60..224: note = Pfam Name: COBRA Pfam Description: COBRA-like protein
  REGION 1..456: note = Bit score of 1007.9 for HMM based on sequences of Figure 7
  REGION 1..456: note = Functional Homolog Of SEQ ID NO. 416
MEFFFTSIARSITKLSSYAILLVLLFSCSIFTSTEAYDSLDPEGNITIKWDVMSWTPDGYVAVVTMFNFQQYRHIQAPGWSLGWSWAKKEVIWSMMGGQTTEQGDCSRFKGNVPHCCKKDPTVVDLLPGTPYNQQIANCCKGGVINSWVQDPANAASSFQVSVGAAGTTNKTVKLPKNFTLRAPGPGYTCGPAKIVKPTKFTTADQRRVTQALMTWNVTCTYSQFLAQKTPTCCVSLSSFYNNTIVSCPTCTCGCQNNLTHPGSCVDPNNPYLASVVEGSGKTSYQPLVQCTSHMCPIRVHWHVKLNYKDYWRVKITITNFNYRMNYTQWNLVVQHPNFDNLTQIFSFNYKSLTPYAAINDTAMLWGVKFYNDLLSQAGPLGNVQSELLFRKDKATFTFDKGWAFPRRIYFNGDNCVMPPPDAYPWLPNASSRPTVSLLYSILTILAVSVIVLAYA

SEQ ID NO: 452 - protein, 457 aa, Populus trichocarpa
  REGION 1..457: note = Public GI ID no. 224124236
  REGION 60..224: note = Pfam Name: COBRA Pfam Description: COBRA-like protein
  REGION 1..457: note = Bit score of 1008.3 for HMM based on sequences of Figure 7
  REGION 1..457: note = Functional Homolog Of SEQ ID NO. 416
MEPSSSLVTVSVTKISAFTILLLFLISCSTLTSTEAYDALDPNGNITIKWDVIQWTPDGYVAVVTMYNFQQYRHIQAPGWTLGWTWAKKEVIWNMMGAQTTEQGDCSKFKGNIPHCCKKDPTVVDLLPGTPYNQQIANCCKGGVINSWAQDPANAVSSFQISVGAAGTTNKTVRVPKNITLKAPGPGYTCGPAKIVRPTKFISADKRRITQALMTWNITCTYSQFLAQKTPTCCVSLSSFYNDTIVSCPTCACGCQNTTGAGSGTCVHPDTPHLASVISPPGKSDNTPLVQCTSHMCPIRVHWHVKLNYKEYWRVKVTVTNFNYRMNYSLWNMVVQHPNFDNLTKIFSFQYKSLTPYEGLNDTAMLWGVKFYNDFLSQAGPLGNVQSELLFRKDKSTFTFEKGWAFPRRIYFNGDNCVMPPPDAYPWLPNDSSRPVISLLLPVMTLFLSMAFLFAHV

SEQ ID NO: 453 - DNA, 1715 bp, Arabidopsis thaliana
  misc_feature 1..1715: note = Ceres Clone ID no. 17250
  misc_feature 1..1715: note = Encodes the peptide sequence at SEQ ID NO. 454
  source 1..1715: mol_type = other DNA
aaaaaatgtctcattgcttctctcgttctaaaaaaaatcttgctgctatctctctataagtccactcctccttcaagcaaagcaccttcctcttctttttgctcctctgagattggtttaagattaaaccagacccatctaagggatctggaacaagcttcgtctctggttccactctgatcatcagagtattaaaaatggagtctttcttctccagatccacctccatcgtctccaaattgagtttcttggccttatggatcgtcttcttgatttcttcatcttcttttacttcgacagaagcatatgatgcgcttgatccagaaggcaacattacaattaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaatctcggatttacggttttgccactggtttgcttagggttacggtggagtggtataaacgtttatttatgattcttttgtgtcccacaaaaattataatcttttgatactttttaaaaatataaatagttttcaacttccttgttttt

SEQ ID NO: 454 - protein, 456 aa, Arabidopsis thaliana
  REGION 1..456: note = Ceres Clone ID no. 17250
  REGION 60..224: note = Pfam Name: COBRA Pfam Description: COBRA-like protein
  REGION 1..456: note = Bit score of 995.6 for HMM based on sequences of Figure 7
  REGION 1..456: note = Functional Homolog Of SEQ ID NO. 416
MESFFSRSTSIVSKLSFLALWIVFLISSSSFTSTEAYDALDPEGNITIKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 455 - DNA, 1371 bp, Arabidopsis thaliana
  misc_feature 1..1371: note = Ceres Annot ID no. 1363625
  misc_feature 1..1371: note = Encodes the peptide sequence at SEQ ID NO. 456
  source 1..1371: mol_type = other DNA
atggagtctttcttctccagatccacctccatcgtctccaaattgagtttcttggccttatggatcgtcttcttgatttcttcatcttcttttacttcgacagaagcatatgatgcgcttgatccagaaggcaacattacaatgaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaa

SEQ ID NO: 456 - protein, 456 aa, Arabidopsis thaliana
  REGION 1..456: note = Ceres Annot ID no. 1363625
  REGION 60..224: note = Pfam Name: COBRA Pfam Description: COBRA-like protein
  REGION 1..456: note = Bit score of 992.7 for HMM based on sequences of Figure 7
  REGION 1..456: note = Functional Homolog Of SEQ ID NO. 416
MESFFSRSTSIVSKLSFLALWIVFLISSSSFTSTEAYDALDPEGNITMKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 457 - DNA, 1362 bp, Populus balsamifera
  misc_feature 1..1362: note = Ceres Annot ID no. 1450185
  misc_feature 1..1362: note = Encodes the peptide sequence at SEQ ID NO. 458
  source 1..1362: mol_type = other DNA
atgggctttcttgtctctcccatgatgagtttgttctcaaaattcactgtcctgctgctttttgtgctttggtgcgctagttttacttcaacagaagcctatgatcctcttgaccctactgggaatattacaatcaaatgggacatcataagctggactgctgatggctatgtcgctgttgtcacgatttacaacttccagcagtatcgtcacattcaagcaccaggatggtcactgggatggacatgggcaaagaaggaggtaatatggagcatgctgggaggccaagcaaccgaccaaggagattgttcaaaattcaaaggaaacgttccacattgttgtaaaaagagtccgacggttgtagatttattgccaggaactccttataaccagcagactgcaaattgctgcaaggggggagttatcagctcatgggcgcaagatccagccaatgcagcaagctccttccagcttagcgtgggttcagctggaaccagtaacaaaacagtgagattaccaaaaaacttcactctgaaggcaccaggacctggttatacttgtgctcgtgcaaaaattgttaagcctactagatttatgtctacagataaaaggagaatcactcaagctttgatgacatggaacgttacttgcacatattcacaattcctggctcagaagactcctagttgctgtgtctccctctcatcattctacaacgacactatagttccttgtccaaaatgcacctgtggctgccaaagaaacaattcggattcggggggttgtgttgatccaaatgcaccacatttagcttcggttgtttcgagtctagggaataacaaccctatgcctcttgtccaatgcacaagtcacatgtgcccgatcagagttcactggcatgttaagcttaactacaagcaatactggcgcgttaaggtcacaattacaaatttcaattataacatgaactatacgcaatggaacttagttgtgcaacaccccaactttgacaatctgacccagagtttcagttttaactaccagtcattatctccttattcagctattaatgatactgccatgttgtggggagtaaagttctacaatgacttgcttatgcaagccggtcgttctggtaatgttcagtcagagctactttttcgaaaggacaagtcaacttttacctttgataaaggctgggccttccctcggagaatctatttcaatggtgacaattgcgttatgcctcctccagatgcgtatccatggttgcctaatgcaagttcacgccagcttacttcaccgcttatgctaatgatagccttcttttctgttttggctttcttatatggatacgcgtag

SEQ ID NO: 458 - protein, 453 aa, Populus trichocarpa
  REGION 1..453: note = Ceres Annot ID no. 1450185
  REGION 57..221: note = Pfam Name: COBRA Pfam Description: COBRA-like protein
  REGION 1..453: note = Bit score of 982.0 for HMM based on sequences of Figure 7
  REGION 1..453: note = Functional Homolog Of SEQ ID NO. 416
MGFLVSPMMSLFSKFTVLLLFVLWCASFTSTEAYDPLDPTGNITIKWDIISWTADGYVAVVTIYNFQQYRHIQAPGWSLGWTWAKKEVIWSMLGGQATDQGDCSKFKGNVPHCCKKSPTVVDLLPGTPYNQQTANCCKGGVISSWAQDPANAASSFQLSVGSAGTSNKTVRLPKNFTLKAPGPGYTCARAKIVKPTRFMSTDKRRITQALMTWNVTCTYSQFLAQKTPSCCVSLSSFYNDTIVPCPKCTCGCQRNNSDSGGCVDPNAPHLASVVSSLGNNNPMPLVQCTSHMCPIRVHWHVKLNYKQYWRVKVTITNFNYNMNYTQWNLVVQHPNFDNLTQSFSFNYQSLSPYSAINDTAMLWGVKFYNDLLMQAGRSGNVQSELLFRKDKSTFTFDKGWAFPRRIYFNGDNCVMPPPDAYPWLPNASSRQLTSPLMLMIAFFSVLAFLYGYA

SEQ ID NO: 459 - protein, 456 aa, Oryza sativa
  REGION 1..456: note = Public GI ID no. 125552171
  REGION 59..223: note = Pfam Name: COBRA Pfam Description: COBRA-like protein
  REGION 1..456: note = Bit score of 981.3 for HMM based on sequences of Figure 7
  REGION 1..456: note = Functional Homolog Of SEQ ID NO. 416
  source 1..456: note = Oryza sativa subsp. indica
MAVGGAGSSRSVAPCCCAVLLAAALLFSAPATTEAYDALDPNGNITIKWDVMSWTPDGYVAVVTMFNYQQFRHIQAPGWQLGWTWAKKEVIWSMVGAQTTEQGDCSKFKGGTPHCCKKDPTVVDLLPGTPYNMQIANCCKAGVINTFNQDPSNAASSFQISVGLAGTTNKTVKLPKNFTLKAPGPGYTCGRAMIVRPTKFFTGDGRRATQALMTWNVTCTYSQFLAQKTPSCCVSLSSFYNDTIVNCPTCSCGCQNNGTSPGSCVNENSPYLQSAIDGPGKWTGQPLVQCTSHMCPIRIHWHVKLNYKEYWRVKITITNFNYRMNYTQWNLVAQHPNFNNITQLFSFNYKPLTPYGSKINDTAMFWGVKFYNDLLMQAGPLGNAQSELLLRKDSKDFTFDKGWAFPHRVYFNGDNCVMPPPDAYPWLPNASPLTKQPLTLSVLVFSIVLATLLAYA

SEQ ID NO: 460 - protein, 457 aa, Oryza sativa
  REGION 1..457: note = Public GI ID no. 115463639
  REGION 60..224: note = Pfam Name: COBRA Pfam Description: COBRA-like protein
  REGION 1..457: note = Bit score of 981.3 for HMM based on sequences of Figure 7
  REGION 1..457: note = Functional Homolog Of SEQ ID NO. 416
  source 1..457: note = Oryza sativa subsp. japonica
MAVGGAGSSRSVAPCCCCAVLLAAALLFSAPATTEAYDALDPNGNITIKWDVMSWTPDGYVAVVTMFNYQQFRHIQAPGWQLGWTWAKKEVIWSMVGAQTTEQGDCSKFKGGTPHCCKKDPTVVDLLPGTPYNMQIANCCKAGVINTFNQDPSNAASSFQISVGLAGTTNKTVKLPKNFTLKAPGPGYTCGRAMIVRPTKFFTGDGRRATQALMTWNVTCTYSQFLAQKTPSCCVSLSSFYNDTIVNCPTCSCGCQNNGTSPGSCVNENSPYLQSAIDGPGKWTGQPLVQCTSHMCPIRIHWHVKLNYKEYWRVKITITNFNYRMNYTQWNLVAQHPNFNNITQLFSFNYKPLTPYGSKINDTAMFWGVKFYNDLLMQAGPLGNAQSELLLRKDSKDFTFDKGWAFPHRVYFNGDNCVMPPPDAYPWLPNASPLTKQPLTLSVLVFSIVLATLLAYA

SEQ ID NO: 461 - DNA, 1660 bp, Arabidopsis thaliana
  misc_feature 1..1660: note = Ceres Annot ID no. 1809854
  misc_feature 1..1660: note = Encodes the peptide sequence at SEQ ID NO. 462
  source 1..1660: mol_type = other DNA
gctaattcgtcatttcttgttactataatcttttcattgttattaatcactttggcttaagtttctgtatattacgtcgagcttcttcagtcttcatccttgtcttgtcacttgtcagagacagaagattaaagaagaagaggcgtttctctctctttttttgcttcagaaaaaatggggtttttcttgtgttcctcttcttcaatcttcttcaagttcggaatctctataatctttctagtttctttctctggtttaactccttcagaagcttatgatcctttggacccgagtgggaacattactgtcaaatgggatatcataacctggactggagatggctatgtggcgactgtaacggtatataattttcagcaatatcgacacattcaagctccaggttggactcttggatggtcatgggcaaagagagaggttatatggggaatgaatggaggacaaaccacagaacaaggagattgttctaaattcaaaggaaccattcctcattgctgtaaaaagacaccttctgttgttgatctcttacctggatctccttacaatcagcagattgctaattgttgcagagggggtgtgcttaactcgtgggctcaagatcccgcaactgctgtttccgctttccagcttactgttggacaagctggaaccacaaataagacagttagggtacctaagaatttcactctcaaagctcctggaccgggatatacttgtagccccgcgaagattgtaaaaccgactagattcatcggtactgataaacgaagagttactcaagcattaatgacttggaatgtaacttgcacatactcgcagttcttagctcagaaaacaccaacttgctgtgtatctctttcatcgttttataacaagacaatagtttcttgtccaacatgctcttgtggatgcagaaacacttctcagccagggaattgtgtagacccaaaaggtccacggatagcatcagtcattccaaatccggggaagaacgcatatataccgcctctggtccaatgtacaaagcatatgtgtccagttagaatccactggcatgtgaaagtcaactacaaacagtactggagagttaaagtcaccatcacaaatttcaactacaacatgaactattcacagtggaatctcgtcgtgcagcatccgaatttcgacaatctaactcagacttttagcttcaactataaacctctgactccttatgcttccataaatgatactgggattctctggggaataaagttctacaatgatctgttgatgcaagctgggccatttggtaatgtacaatctgagctacttttccagaaagaagcatcagctttcacatttgagaaaggttgggcgtttccaagaagaatctatttcaatggagataactgtgtgatgcctcctcctgattcttacccttggctgcccaataccggctcgcacaaatcagtcggttccctgtttgcagcaatggccttgttactgattgtgttcctacatggaaacttgtaagaatcatcaagtgtagaattcttctgctgcagtttttcgaactgatataacccatcaagagagagttggtagcttagttttttgtgttctctcttgtctgtcctcttcctgtacaacgctttaatat

SEQ ID NO: 462 - protein, 452 aa, Arabidopsis thaliana
  REGION 1..452: note = Ceres Annot ID no. 1809854
  REGION 57..221: note = Pfam Name: COBRA Pfam Description: COBRA-like protein
  REGION 1..452: note = Bit score of 966.5 for HMM based on sequences of Figure 7
  REGION 1..452: note = Functional Homolog Of SEQ ID NO. 416
MGFFLCSSSSIFFKFGISIIFLVSFSGLTPSEAYDPLDPSGNITVKWDIITWTGDGYVATVTVYNFQQYRHIQAPGWTLGWSWAKREVIWGMNGGQTTEQGDCSKFKGTIPHCCKKTPSVVDLLPGSPYNQQIANCCRGGVLNSWAQDPATAVSAFQLTVGQAGTTNKTVRVPKNFTLKAPGPGYTCSPAKIVKPTRFIGTDKRRVTQALMTWNVTCTYSQFLAQKTPTCCVSLSSFYNKTIVSCPTCSCGCRNTSQPGNCVDPKGPRIASVIPNPGKNAYIPPLVQCTKHMCPVRIHWHVKVNYKQYWRVKVTITNFNYNMNYSQWNLVVQHPNFDNLTQTFSFNYKPLTPYASINDTGILWGIKFYNDLLMQAGPFGNVQSELLFQKEASAFTFEKGWAFPRRIYFNGDNCVMPPPDSYPWLPNTGSHKSVGSLFAAMALLLIVFLHGNL

SEQ ID NO: 463 - protein, 460 aa, Zea mays
  REGION 1..460: note = Public GI ID no. 162462330
  REGION 57..223: note = Pfam Name: COBRA Pfam Description: COBRA-like protein
  REGION 1..460: note = Bit score of 935.6 for HMM based on sequences of Figure 7
  REGION 1..460: note = Functional Homolog Of SEQ ID NO. 416
MAPPPLLPARFVAASVALLAVAFSSSLTRPSGAYDPLDPNGNITIKWDVIQWTADGYVAVVSLYNYQQYRHIQAPPGWRLGWVWAKKEVIWAMTGGQATEQGDCSRFKASVLPHCCRRDPEVVDLLPGTPYNTQTANCCRGGVLASWAQDPSDAVASFQVSVGQAGSTNRTVKVPRNFTLLAPGPGYTCGAAKLVKPTKFMSQDGRRSTQAHMTWNVTCTYSQFLAQRSPTCCVSLSSFYNDTIVSCPACSCGCQNNNSSSTAAPGSCVEGSRRSPYLASVVNDPSKNSLAPLVQCTSHMCPVRVHWHVKVSYKEYWRVKITVTNFNYRMNYSQWNLVAQHPNFDNLTTIFSFNYRPLNPYGVINDTAMLWGIKYYNDLLMTAGPDGNVQSELLFRKEPSTFTFHKGWAFPRRVYFNGDNCVMPPPDAYPWLPNAASPRLSPSLLLPLVAAAWTAFAVLS

SEQ ID NO: 464 - DNA, 1326 bp, Arabidopsis thaliana
  misc_feature 1..1326: note = Ceres Annot ID no. 1326475
  misc_feature 1..1326: note = Encodes the peptide sequence at SEQ ID NO. 465
  source 1..1326: mol_type = other DNA
atgaacattctcttctccagattctcctttttgcttctgtttctctgttcttggaccagtttcactttcaccacaacagaagcttatgatgcacttgatccatatggaaacattactataaaatgggatattatgagctggactggtgatggttatgtggctgttgtaacaatctttaatttccaacaataccgtcacattgaggcgccggggtggcaattaggatggagttggatgaagaaggaagtaatttggagtatggttggtggtcaagcaacagaacaaggagattgttctaagtttaagggtaacattcctcattgctgcaagaaaactccggctatcgttgatttgttaccgggaactccttataaccaacagatatcaaactgttgtagaggcggtgtgattagcgcgtgggcgcaagaccccgcaaccgcgatttcttcgtttcagattagtgttggccagtctggaacaactaatactacggttagagcacctaggaatataactttgaaggctccaggacctggttacacttgcgggcctgcaaaactcgttaagccgagtagattcatttccgcggataaacgaagaaagactcagtctttgcttacatggaacattacttgcacatattcgcagtttctagcacggaaaactccgacttgttgtgtctcactctcagccttctacaatgaaactatagtaccatgtccaacttgttcttgtggatgtcaaaatagttctcaagctggtacatgtgttgaccctaaaatagcttcagtagtaccagccttagggaagaacaacctcgaacctctcttgcaatgtacgcaacatatgtgtcccattcgagttcattggcatgtaaaaactagctacaaagagtactggagagtgaaggttgccatcacaaactttaactacaatatgaactactctcagtggaacttagtcgttcagcatcccaacttcgacaatctcactaagcttttcagtttcaactacaaaccgcttaatccttacttgaacataaatgacacggccatgctatggggaatcaagttctacaatgattttttaagccaagctggtccagtaggcaatgtacagtcagagcttctcttccaaaagaacccattggagttcacattcgagaaaggatgggcgtttccgaggcgcatatacttcaacggtgataactgcgttatgccacctccagactcttatccatggcttccaaacgctagtccaaacattgcaacctcgccatttgtcatacttctcatcactttcttatctgttttgattcttatgtaa

SEQ ID NO: 465 - protein, 441 aa, Arabidopsis thaliana
  REGION 1..441: note = Ceres Annot ID no. 1326475
  REGION 52..216: note = Pfam Name: COBRA Pfam Description: COBRA-like protein
  REGION 1..441: note = Bit score of 946.0 for HMM based on sequences of Figure 7
  REGION 1..441: note = Functional Homolog Of SEQ ID NO. 416
MNILFSRFSFLLLFLCSWTSFTFTTTEAYDALDPYGNITIKWDIMSWTGDGYVAVVTIFNFQQYRHIEAPGWQLGWSWMKKEVIWSMVGGQATEQGDCSKFKGNIPHCCKKTPAIVDLLPGTPYNQQISNCCRGGVISAWAQDPATAISSFQISVGQSGTTNTTVRAPRNITLKAPGPGYTCGPAKLVKPSRFISADKRRKTQSLLTWNITCTYSQFLARKTPTCCVSLSAFYNETIVPCPTCSCGCQNSSQAGTCVDPKIASVVPALGKNNLEPLLQCTQHMCPIRVHWHVKTSYKEYWRVKVAITNFNYNMNYSQWNLVVQHPNFDNLTKLFSFNYKPLNPYLNINDTAMLWGIKFYNDFLSQAGPVGNVQSELLFQKNPLEFTFEKGWAFPRRIYFNGDNCVMPPPDSYPWLPNASPNIATSPFVILLITFLSVLILM

SEQ ID NO: 466 - protein, 446 aa, Oryza sativa
  REGION 1..446: note = Public GI ID no. 125559101
  REGION 52..216: note = Pfam Name: COBRA Pfam Description: COBRA-like protein
  REGION 1..446: note = Bit score of 954.5 for HMM based on sequences of Figure 7
  REGION 1..446: note = Functional Homolog Of SEQ ID NO. 416
  source 1..446: note = Oryza sativa subsp. indica
MALLLLRMGVSVALLVAFFSSLIPSSEAYDPLDPNGNITIKWDVLQWTPDGYVAVVSLYNYQQYRHIQSPGWKLGWVWAKKEIIWAMNGGQATEQGDCSKFKSNIPHCCKKDPEIVDLLPGTPYNMQIANCCKGGVLNSWAQDPANAIASFQVSVGQAGTTNKTVRVPRNFTLKSPGPGYTCGSAKVVRPTKFFSQDGRRTTQAHMTWNVTCTYSQIVAQRSPTCCVSLSSFYNDTIVNCPTCSCGCQNNKPGSCVEGNSPYLASVVNTHNKDSLTPLVQCTSHMCPIRVHWHVKVNYKEYWRVKITVTNFNYRMNYSQWNLVTQHPSFDNLTTIFSFNYKSLNPYGVINDTAMLWGIKYYNDLLMTAGPDGNVQSELLFKKDPKSFTFEKGWAFPRRIYFNGDNCVMPPPDAYPWLPNASTRVMSSILLPFITIWTALTFLMVYA

SEQ ID NO: 467 - DNA, 1350 bp, Sorghum bicolor
  misc_feature 1..1350: note = Ceres Annot ID no. 8632643
  misc_feature 1..1350: note = Encodes the peptide sequence at SEQ ID NO. 468
  source 1..1350: mol_type = other DNA
atggcggcgggcggcagatccgtcgcgtgctgtgccgccgtgctgctcgcggccgcgctgctcctctccgcaccgactaccacagaggcttatgattcgctggatccaaccggcaacatcactataaaatgggatattatgcagtggactcctgacggatatgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttactaccaggcactccatacaacatgcaaattgccaattgctgcaaggcaggagtcataaatacctttaaccaggacccagcaaatgctgcttcctccttccagatcagtgttggtcttgccggaactaccaataaaactgttaaggtgccaaagaacttcactcttaagactccaggccctgggtacacatgtgggcgtgccattgttggcaggccgacaaagttttggagcgcagatgggcgcagggcaacccaagctctaatgacatggaatgtgacctgcacatattcccaatttcttgctcagaagactccatcctgctgtgtctctctctcatcgttttataatgacacaattgtgaactgcccaacatgctcatgtggctgccagaacccaagtgggtcaaactgtgtgaatgaggattcacctaatctacaagctgcaattgatggtcctggcaaatggactggccagcctcttgtacaatgcacttcccacatgtgcccgataagaatccactggcatgtgaagctcaactacaaggaatactggagagtgaaaatcactatcacaaacttcaacttccgcatgaattacacgcagtggaacttagtagctcagcatccaaactttgataacatcactcagttgttcagcttcaactacaaaccacttactccatatgggggtggcataaatgatacggcaatgttctggggtgtaaaattctacaatgatttgctgatgcaagccggcaaacttggaaatgtgcaatcggaactgcttctccgcaaggactcccggactttcaccttcgataaggggtgggccttcccacgccgggtgtacttcaatggtgataattgtgtcatgccatctcctgaaaattatccatggctgccgaatgcaagccctctaacaagacaaccattgacactcccactcttggtattctgggttgccttggctgctctgttggcttatgcatga

SEQ ID NO: 468 - protein, 449 aa, Sorghum bicolor
  REGION 1..449: note = Ceres Annot ID no. 8632643
  REGION 54..218: note = Pfam Name: COBRA Pfam Description: COBRA-like protein
  REGION 1..449: note = Bit score of 965.1 for HMM based on sequences of Figure 7
  REGION 1..449: note = Functional Homolog Of SEQ ID NO. 416
MAAGGRSVACCAAVLLAAALLLSAPTTTEAYDSLDPTGNITIKWDIMQWTPDGYVAVVTMYNFQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFWSADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFDKGWAFPRRVYFNGDNCVMPSPENYPWLPNASPLTRQPLTLPLLVFWVALAALLAYA

SEQ ID NO: 469 - DNA, 1849 bp, Zea mays
  misc_feature 1..1849: note = Ceres Clone ID no. 1546455
  misc_feature 1..1849: note = Encodes the peptide sequence at SEQ ID NO. 470
  source 1..1849: mol_type = other DNA
gccctcctcaccactgcccccccattccccggcgcccagcacccggcgccgcaaccgccgcagtccggagcaagatcggtgggtagacggacgggcgacaggcgggcgggcgcggctctgtctgtatctatctgttggtgggagaccggttgtgtcggttaggcggcggcgggtgggaaggaagaatggcggcgggcggcagatccatcgcgtgcgttgccgccgtgctgctcgcggccgcgctgctcctctccgcaccgaccaccacagaggcctacgattcgctggatccaaacggcaacatcactataaaatgggatatcatgcagtggactcctgacggatatgtcgctgttgtcacaatgttcaattatcaacaatttcggcacatcggggcacctggatggcagcttgggtggacatgggcaaaaaaggaggttatatggtcaatggttggggctcagaccactgaacagggtgactgctcaaagttcaagggcaacaccccccattgctgcaagaaagatccaacaattgttgatttacttccaggcactccatacaacatgcaaattgccaattgctgcaaggcaggagttataaatacctttaaccaggacccagcaaatgctgcttcctccttccagatcagtgttggtcttgctggaactaccaataaaactgttaaggtgccgaagaatttcactcttaagactccaggccctgggtacacatgtgggcgtgctattgttggcaggccaacgaagtttttctctgcagatgggcgcagggtaacccaagctctaatgacatggaatgtgacctgcacatattcccaatttcttgctcagaagactccatcctgctgtgtatctctctcatcattttataatgacacaattgtgaactgcccgacatgctcatgtggctgccagaacccaagtgggtcaaactgtgtgaacgaggattcacctaatctacaagccgcaattgatggtcctggtaaatggactggccagcctcttgtacaatgcacttctcacatgtgcccaataagaatccactggcatgtgaagctcaactacaaggaatactggagagtgaaaatcactatcacgaacttcaacttccgcatgaattacacacagtggaacttagttgctcagcatccaaactttgataatatcactcagttgttcagcttcaactacaaaccacttactccatatgggggtggcataaatgatacggcaatgttctggggtgtaaagttctacaatgatttgctgatgcaagccggcaaacttgggaatgtgcaatcagaactgcttctccgcaaggactcacggactttcacattcgaaaagggatgggccttcccacgccgagtgtacttcaatggtgataattgtgtcatgccatctcctgaaaattatccatggctgccgaatgcaagccctctaacaaaacaagcattgacactcccactcttgatattctgggttgccttggctgttctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtggatgtgtgtgtgtgtgtgtttgtaagttaaagggccaaaatgtatttcttgtctggtagtatatagcagctctacaacactttggtgaacttagttactgcaaattaggcaattacagttgcaccttttgtattttatagcaaacccagacttctattggattctatgactgcccctcttgtagc

SEQ ID NO: 470 - protein, 449 aa, Zea mays
  REGION 1..449: note = Ceres Clone ID no. 1546455
  REGION 54..218: note = Pfam Name: COBRA Pfam Description: COBRA-like protein
  REGION 1..449: note = Bit score of 967.2 for HMM based on sequences of Figure 7
  REGION 1..449: note = Functional Homolog Of SEQ ID NO. 416
MAAGGRSIACVAAVLLAAALLLSAPTTTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFSADGRRVTQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQALTLPLLIFWVALAVLLAYA

SEQ ID NO: 471 - DNA, 1948 bp, Panicum virgatum
  misc_feature 1..1948: note = Ceres Clone ID no. 1788775
  misc_feature 1..1948: note = Encodes the peptide sequence at SEQ ID NO. 472
  source 1..1948: mol_type = other DNA
aagggagcagccgctgcggagcagagtgtcgcgctgccgccgcggtaaaaacaggggaggagggagagacgcggccgcacccgcacatgctttaagtcccactccccaccgccccagatctccgccctcctccctctgccccccacattccccggcgcgccacctctgcccgcggccgccgccgctgtccggagcgagatcggcgtgggtgcacgggcgcagctcctgtatctgtcggtgggagaccccgcgcgtgtcggtgggagcgggtggggaggaagcgaaggatggcggcgggcggcagatccgtcgcgtgctgcaccgccgtgctgctcgcggccgcgctgctcctctccgcgccgactgccacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactaccgaacagggtgactgctcgaaattcaagggcaacactccccactgctgcaagaaagatcccacgatcgtcgatttacttccgggcactccatacaacatgcaaattgccaattgctgcaaagcaggagttataaatacatttaatcaggacccagcaaatgctgcttcctccttccagattagtgtaggtcttgctgggactaccaataagactgttaaggtgccgaagaacttcactcttaagactccaggtcctgggtacacctgtgggcgtgccattgttggcaggccgacaaagtttttcacctcggatggacgcagggcaacccaagctctaatgacgtggaatgtgacttgcacatattcccaatttctagcccagaagactccgtcctgctgtgtatctctctcatcattttacaatgacacaattgtgaactgcccaacatgctcttgtggctgccaaaatccaagtggctccaactgtgtgaatgaggattcaccgaatctacaatctgcaattgatggccctgggaaatggactggtcagcctcttgtacaatgcacctcccacatgtgcccgataagaatccactggcatgtgaagctcaattacaaggaatactggagagtgaaaatcactatcacaaacttcaacttccgcatgaattacacgcagtggaacttagtcgttcagcatccaaactttgataatatcactcagctgttcagtttcaactacaaaccacttaccccatatggtggtggcataaatgatacggcaatgttctggggtgtaaaattctacaacgatttgctgatgcaagctggtaaacttgggaatgtgcaatcagaactacttcttcgcaaggactcccaggctttcaccttcgaaaagggatgggccttcccacgccgagtgtacttcaatggtgataactgtgtcatgccatctcctgaaaattatccatggctgcccaatgcaagccctctaacaaaacaaccattgacactcccactcttagtattctgggttgtgttggctactctgttggcttatgcgtgatgagtgggatcaagagatttagcgagcttcaagttgatgtcagattccatgaggtgcactgcagcaggccatttgttcattcacttccatggttgcacagaagagatgacaccacgccgagaaaagaaagtttatatgtgtgtgtgtttttggaagttaaggcccaaaatgtatttcttgtctggtatatactggccccacagcactttggtgaacttagttactgcaaattaggtaattacagttgcaccttttgtattttatagcaaactcagaatttttcattgaattatgactgctcttcttgtagc

SEQ ID NO: 472 - protein, 449 aa, Panicum virgatum
  REGION 1..449: note = Ceres Clone ID no. 1788775
  REGION 54..218: note = Pfam Name: COBRA Pfam Description: COBRA-like protein
  REGION 1..449: note = Bit score of 965.1 for HMM based on sequences of Figure 7
  REGION 1..449: note = Functional Homolog Of SEQ ID NO. 416
MAAGGRSVACCTAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLLVFWVVLATLLAYA

SEQ ID NO: 473 - protein, 449 aa, Zea mays
  REGION 1..449: note = Public GI ID no. 162462156
  REGION 54..218: note = Pfam Name: COBRA Pfam Description: COBRA-like protein
  REGION 1..449: note = Bit score of 967.2 for HMM based on sequences of Figure 7
  REGION 1..449: note = Functional Homolog Of SEQ ID NO. 416
MAAGGRSIACFAAVLLAAALLLSAPTTTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFSADGRRVTQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQALTLPLLIFWVALAVLLAYA

SEQ ID NO: 474 - protein, 456 aa, Oryza sativa
  REGION 1..456: note = Public GI ID no. 125545759
  REGION 59..223: note = Pfam Name: COBRA Pfam Description: COBRA-like protein
  REGION 1..456: note = Bit score of 969.4 for HMM based on sequences of Figure 7
  REGION 1..456: note = Functional Homolog Of SEQ ID NO. 416
  source 1..456: note = Oryza sativa subsp. indica
MAAGGGAGSARSVAWGASALLVAALLLSAPSATEAYDSLDPNGNITIKWDVMQWTPDGYVAVVTMFNYQQFRHIQAPGWQLGWTWAKKEVIWSMVGAQTTEQGDCSKFKGNPPHCCKKDPTIVDLLPGTPYNMQIANCCKAGVINTFNQDPLNAASSFQISVGLAGTTNKTVKLPKNFTLKAPGPGYTCGRAMIVRPTKFFTNDGRRATQALMTWNVTCTYSQFLAQKTPTCCVSLSSFYNDTIVNCPTCSCGCQNNGTSPGSCVNENSPYLQSAIDGPGKWTGQPLVQCTSHMCPIRIHWHVKLNYKEYWRVKVTITNFNYRMNYTQWNLVIQHPNFNNITQLFSFNYKPLTPYGGRINDTAMFWGVKFYNDLLMQAGPLGNAQSELLLRKDSMAFTFDKGWAFPHRVYFNGDNCVMPPPDAYPWLPNASPLTKQPLTLPLLAFWIVLATFLAYA

SEQ ID NO: 475 - DNA, 1845 bp, Zea mays
  misc_feature 1..1845: note = Ceres Clone ID no. 236876
  misc_feature 1..1845: note = Encodes the peptide sequence at SEQ ID NO. 476
  source 1..1845: mol_type = other DNA
gagtgtctcgtgctgctgcttccgctgcagtaaaatacggggaagaggaggggagggagacgcggccgctgcctgccgcacatgctttaagtcccactccccacctccccagatctccgccctcctccccaccgcccccattcctcccctcggccgcaaccgtagccgccgcactacggagcaagatcgtcgggtagacggacgggcgggcgggcgggcgcggctctgtatctatctgtcggtgggagaccgcgtgtgtcggttaggcggcgggtggcaaggaagaatggcggcgagcggcagatccgtcgcgtgctgtgccgccgcgctgctcgcggccgcgttgctcctctccgcaccgactgcaacagaggcttatgattcgctggatccaaatggcaacatcaccataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccagcaaatgctgcttcctccttccagatcagtgttggtcttgctggaactaccaataaaactgttaaggtgcccaggaacttcactcttaagactccaggccctgggtacacatgtgggcgtgccattgttggcaggcctacgaagtttttcaccgcggacgggcgcagggcaacccaagctctaatgacatggaatgtgacctgcacatattcccaatttcttgctcagaagactccatcctgctgtgtatctctatcatcgttttataatgacacaattgtgaactgcccaacatgctcatgtggctgccagaacccaagtgggtcaaactgtgtgaatgaggattcacctaatctacaagctgcaattgatggccctggcaaatgcactggtcagccccttgtacaatgcacttcccacatgtgcccgataagaatccactggcatgtgaagctcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatataacagccctacaacactttggtgaactg

SEQ ID NO: 476 - protein, 448 aa, Zea mays
  REGION 1..448: note = Ceres Clone ID no. 236876
  REGION 54..218: note = Pfam Name: COBRA Pfam Description: COBRA-like protein
  REGION 1..448: note = Bit score of 960.4 for HMM based on sequences of Figure 7
  REGION 1..448: note = Functional Homolog Of SEQ ID NO. 416
MAASGRSVACCAAALLAAALLLSAPTATEAYDSLDPNGNITIKWDIMQWTPDGYVAVVTMFNYQQFRHIGAPGWQLGWTWAKKEVIWSMVGAQTTEQGDCSKFKSSPPHCCKKDPTIVDLLPGTPYNMQIANCCKAGVVNTFNQDPANAASSFQISVGLAGTTNKTVKVPRNFTLKTPGPGYTCGRAIVGRPTKFFTADGRRATQALMTWNVTCTYSQFLAQKTPSCCVSLSSFYNDTIVNCPTCSCGCQNPSGSNCVNEDSPNLQAAIDGPGKCTGQPLVQCTSHMCPIRIHWHVKLNYKDYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKPLALPFLVFWVALAALLAYA

SEQ ID NO: 477 - DNA, 1380 bp, Sorghum bicolor
  misc_feature 1..1380: note = Ceres Annot ID no. 8640602
  misc_feature 1..1380: note = Encodes the peptide sequence at SEQ ID NO. 478
  source 1..1380: mol_type = other DNA
atggcgaggctgcgactcctactgctccggcatctggctgccgccgctgctctgctcgccggcttctcttctctgccacctttggcagaagcatatgatcctcttgatccaaatgggaatatcacaataaaatgggatatcattcagtggacttcagatggttatgttgctgttgtttccatatacaattaccataaataccgacatatccaagcacccgggtggaaccttggatgggtgtgggcaaagaaggagatcatctggaccatagttggcgggcagaccacagagcaaggggattgctctcagttcaaaggcagtataccacactgctgcaagagggatccagcagttgttgacttgcttcctgggacaccttacaacatgcaggatgcaaattgttgcaaaggaggagtgcttaactcatgggttcaagacccagtcagtgcagtggcatcgtttcagatcagtgtcggccgatctggtactaccaactacacagtgaaagcgccactaaacttcactctgaaggccccaggaccaggatacagttgtggagtagctcatgtggtgaagcctcctacgaagttcatttcccaggacggaaggagaaccactcaagctcatgtgacatggaacgtgacatgtacatattcccaatttgttgctcagcgggctccaacttgttgtgtttcactctcatcattttacaatgaaaccatagttaactgcccaaaatgttcatgtggctgtcagaataccagaccgggaagttgtgttgagggtgattcaccttatttggcttctgtcgtgaatggaccgggcaagagcagcatgactcctctagttcagtgcacgccccatatgtgcccgataagagtgcattggcatgttaagctcaactacagggaatactggagggtgaagatcacggttacaaactggaattaccggatgaattactcacaatggaacttggtagttcagcacccaaatttcgacaaagttaccactattttcagcttcaactacaagcctctgaacccctatggagtaataaatgatactggaatgctgtggggtatcaagtactacaatgacctgctcatggtggctgggccagatggaaatgtgcaatctgagcttctgttccggaaggacccgtcgacattcactttcgagaaaggctgggcgttcccaaggcggatatacttcaatggcgacagctgtgtcatgcctccaccagatgcgtacccatggctaccaaactcttcccctgtactcctactgaagagctcatccctcgttctgcccatcgtgatttggacggcgatgctgttcttacggcttggtatgtactcaatccatcccaaattgtaa

SEQ ID NO: 478 - protein, 459 aa, Sorghum bicolor
  REGION 1..459: note = Ceres Annot ID no. 8640602
  REGION 55..220: note = Pfam Name: COBRA Pfam Description: COBRA-like protein
  REGION 1..459: note = Bit score of 916.3 for HMM based on sequences of Figure 7
  REGION 1..459: note = Functional Homolog Of SEQ ID NO. 416
MARLRLLLLRHLAAAAALLAGFSSLPPLAEAYDPLDPNGNITIKWDIIQWTSDGYVAVVSIYNYHKYRHIQAPGWNLGWVWAKKEIIWTIVGGQTTEQGDCSQFKGSIPHCCKRDPAVVDLLPGTPYNMQDANCCKGGVLNSWVQDPVSAVASFQISVGRSGTTNYTVKAPLNFTLKAPGPGYSCGVAHVVKPPTKFISQDGRRTTQAHVTWNVTCTYSQFVAQRAPTCCVSLSSFYNETIVNCPKCSCGCQNTRPGSCVEGDSPYLASVVNGPGKSSMTPLVQCTPHMCPIRVHWHVKLNYREYWRVKITVTNWNYRMNYSQWNLVVQHPNFDKVTTIFSFNYKPLNPYGVINDTGMLWGIKYYNDLLMVAGPDGNVQSELLFRKDPSTFTFEKGWAFPRRIYFNGDSCVMPPPDAYPWLPNSSPVLLLKSSSLVLPIVIWTAMLFLRLGMYSIHPKL

SEQ ID NO: 479 - protein, 457 aa, Triticum monococcum
  REGION 1..457: note = Public GI ID no. 30090032
  REGION 59..223: note = Pfam Name: COBRA Pfam Description: COBRA-like protein
  REGION 1..457: note = Bit score of 945.1 for HMM based on sequences of Figure 7
  REGION 1..457: note = Functional Homolog Of SEQ ID NO. 416
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTALATLLAYYV

SEQ ID NO: 480 - protein, 456 aa, Triticum aestivum
  REGION 1..456: note = Public GI ID no. 38230578
  REGION 59..222: note = Pfam Name: COBRA Pfam Description: COBRA-like protein
  REGION 1..456: note = Bit score of 926.7 for HMM based on sequences of Figure 7
  REGION 1..456: note = Functional Homolog Of SEQ ID NO. 416
MAPVGGVAGSSRSAACCAVLLAAVLFFSAPATTEAYDSLDPNGNITIKWDIISWTPDGYVATVTMFNYQQFRHIPAPGWQLGCSWAKKEVIWSMVGAQATEQGDCSKFKSAPPHCCKRDPTIVDLLPGTPFNQQIANCCKAGVIKTFNQDPGNAASSFQISVGLAGTTNKAVKMPKNFTLRAPGPGYTCGRALVGRPTKYYSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLSTLLAYYV

SEQ ID NO: 481 - protein, 458 aa, Oryza sativa
  REGION 1..458: note = Public GI ID no. 115453533
  REGION 53..218: note = Pfam Name: COBRA Pfam Description: COBRA-like protein
  REGION 1..458: note = Bit score of 914.2 for HMM based on sequences of Figure 7
  REGION 1..458: note = Functional Homolog Of SEQ ID NO. 416
  source 1..458: note = Oryza sativa subsp. japonica
MARFLLGAAAIALLAGVSSLLLMVPFAEAYDPLDPNGNITIKWDITQWTPDGYVAVVTIYNFQKYRHIQAPGWSLGWAWAKKEIIWSMAGGQATEQGDCSAFKANIPHCCKRDPRVVDLVPGAPYNMQFGNCCKGGVLTSWVQDPLNAVASFQITVGHSGTSNKTVKAPKNFTLKAPGPGYSCGLAQEVKPPTRFISLDGRRTTQAHVTWNVTCTYSQFVAQRAPTCCVSLSSFYNETIVNCPKCACGCQNKKPGSCVEGNSPYLASVVNGPGKGSLTPLVQCTPHMCPIRVHWHVKLNYRDYWRVKVTITNWNYRMNYSQWNLVVQHPNFENVSTVFSFNYKSLNPYGVINDTAMMWGVKYYNDLLMVAGPDGNVQSELLFRKDRSTFTFDKGWAFPRRIYFNGESCVMPSPDLYPWLPPSSTPRFRTVFLLMSFLVCGTLAFLHNHLVLDKNCGKC

SEQ ID NO: 482 - DNA, 667 bp, Panicum virgatum
  misc_feature 1..667: note = Ceres Clone ID no. 1767521
  misc_feature 1..667: note = Encodes the peptide sequence at SEQ ID NO. 483
  source 1..667: mol_type = other DNA
ctgaatccagcaagccacaagaggcagctgctgcttctgcttgcctgcctggctgcatctgcaggctagcatcgatcgcacaccagagtgctcgatcagccaaccaatcaatccagcagccatccggcgtcagcctccgcgccgactggccggatccttctcagcggcggcacgccatgaccaagcaaaagatcgtgatcagggtgaacctggcgagcgagaagacccggtccaaggccatggcgctggtcgccagagcggacggggtgagctcgatgggggttaccggcgacggcagggaccagctggaggtggtcggcgacggcgtcgacaccgtcggcctcgtccagtgcctgcgcaagaagatcgggcacgccgagatcctcaaggtggaggaagtgaagccggcggagaagaagcccgaggagaagaagccggagccgctgccggactggtggtggtaccacaattactaccactaccacccgccgccgccgtgctggtgaggtggccccggtggtcgccagccagccatggaagcggcggccgtttttgatgtattactagttgggaattggaattcaactcgtgctcgccttatatttgtattcgagctgttctgtatttgggtgaaaacaaaaaaaaggcaaaagacggttacttgtcc

SEQ ID NO: 483 - protein, 109 aa, Panicum virgatum
  REGION 1..109: note = Ceres Clone ID no. 1767521
  REGION 1..109: note = Ceres Seed Line no. cDNA_ID_40670745
  REGION 1..109: note = Bit score of 287.6 for HMM based on sequences of Figure 1
  REGION 1..109: note = Figure 1
MTKQKIVIRVNLASEKTRSKAMALVARADGVSSMGVTGDGRDQLEVVGDGVDTVGLVQCLRKKIGHAEILKVEEVKPAEKKPEEKKPEPLPDWWWYHNYYHYHPPPPCW

SEQ ID NO: 484 - DNA, 324 bp, Sorghum bicolor
  misc_feature 1..324: note = Ceres Annot ID no. 8701398
  misc_feature 1..324: note = Encodes the peptide sequence at SEQ ID NO. 485
  source 1..324: mol_type = other DNA
atgaagcaaaagatcgtgatcaggctgagcgtggcgagcgacaagtgccggtccaaggccatggtgctggcggccaaagcagacggggtgagcaagatggggatcaccggcgacggaaaggaccagctggaggtggagggcgacggcatcgacaccgtctgcctcgtcaactgcctgcgcaagaagatcggccgcgccgacatcgtcaaggtggaggtggtgaagcccgaggagaagaaaccggaggagaagaagcccgaggtcgtgccgctgccgtacggctggtgctaccccaattactaccagtaccacccgcactggtag

SEQ ID NO: 485 - protein, 107 aa, Sorghum bicolor
  REGION 1..107: note = Ceres Annot ID no. 8701398
  REGION 1..107: note = Bit score of 264.7 for HMM based on sequences of Figure 1
  REGION 1..107: note = Functional Homolog Of SEQ ID NO. 483
  REGION 1..107: note = Figure 1
MKQKIVIRLSVASDKCRSKAMVLAAKADGVSKMGITGDGKDQLEVEGDGIDTVCLVNCLRKKIGRADIVKVEVVKPEEKKPEEKKPEVVPLPYGWCYPNYYQYHPHW

SEQ ID NO: 486 - protein, 119 aa, Oryza sativa
  REGION 1..119: note = Public GI ID no. 21741986
  REGION 1..119: note = Bit score of 296.6 for HMM based on sequences of Figure 1
  REGION 1..119: note = Functional Homolog Of SEQ ID NO. 483
  REGION 1..119: note = Figure 1
  source 1..119: note = Oryza sativa subsp. japonica
MTKQKIVIKVSMPCEKSRSKAMALVARASGVNSMEVTGDGKDRLQVVGDGVDPVCLVACLRRKIGYAEIVQVEEVKDKKPEEKQPEPPKPVPCYYPAPPCYYPPATVVCSDEPSPCSIM

SEQ ID NO: 487 - DNA, 699 bp, Zea mays
  misc_feature 1..699: note = Ceres Clone ID no. 488555
  misc_feature 1..699: note = Encodes the peptide sequence at SEQ ID NO. 488
  source 1..699: mol_type = other DNA
aaagtcccaccacagcaaagcaactgcttgcagcctccgcacaacaaaaaaccccacgggtagtctcggatctccacgccaccaaaacattcgaagcttcttcgatctcttgcgcggcgttctggaatctgaaccttcaatcttggagagcggcgcgtccccaaagaattagatcagccatggccaagcaaaagatcgtgatcaaggtgccgatggcgagcgacaagtcccggtccaaggcaatggcgctggtggcagccgcgggcggggtcaactccgtggccatcgccggcgacggcaaggaccaggtggtcgtcgttggcgagggcgtcgactccatcaagctcaccaccatcctgcgcaagaagatgggcgacgcgcagctcgtcgaggtcgccgaggacaagaagaaggaggagaagaagcccgaccccgtcgccgaagctgcggcggcgtactacaaccagtactactaccactacccaccgccggscgccgtcgtttacgacccctacccacggccgggcaacacctgctccataatgtagactcagcctgtggacatatgcaagttaagttttgtgtgtagcggtgcgtgtgtgggggaggcgcgcaagtgtagtttctatacggaattcttctcttatctcccttttgaggttaagggcatgtgcagtcccagttaatatatggtcattc

SEQ ID NO: 488 - protein, 122 aa, Zea mays
  REGION 1..122: note = Ceres Clone ID no. 488555
  REGION 1..122: note = Bit score of 296.5 for HMM based on sequences of Figure 1
  REGION 1..122: note = Functional Homolog Of SEQ ID NO. 483
  REGION 1..122: note = Figure 1
  VARIANT 105: note = X can be any amino acid
MAKQKIVIKVPMASDKSRSKAMALVAAAGGVNSVAIAGDGKDQVVVVGEGVDSIKLTTILRKKMGDAQLVEVAEDKKKEEKKPDPVAEAAAAYYNQYYYHYPPPXAVVYDPYPRPGNTCSIM

SEQ ID NO: 489 - DNA, 366 bp, Populus balsamifera
  misc_feature 1..366: note = Ceres Annot ID no. 1472210
  misc_feature 1..366: note = Encodes the peptide sequence at SEQ ID NO. 490
  source 1..366: mol_type = other DNA
atgaagcaaaagatagtgatcaaggtgacggtgaatggaccgaagtcccgctccaaatccttgcagattgcagttgggttttcaggtgttgaatctgctggtttaggagggcaagataagagccagatagaggtggtaggcgatggagttgatgcagtagaacttacaaatcgtctgagaaagaaagtaggctacgcagagatagtaagtgtagcagctgtgggagaaaagaaagaagagaagaaaccggaggcagtagtgcagcctgttctttggtccatgtatggtggaggcgtgcctcagacctatatccatccgattcacccccccaactattatcaggacccttcgtgctccatcatgtaa

SEQ ID NO: 490 - protein, 121 aa, Populus trichocarpa
  REGION 1..121: note = Ceres Annot ID no. 1472210
  REGION 1..121: note = Bit score of 296.4 for HMM based on sequences of Figure 1
  REGION 1..121: note = Functional Homolog Of SEQ ID NO. 483
  REGION 1..121: note = Figure 1
MKQKIVIKVTVNGPKSRSKSLQIAVGFSGVESAGLGGQDKSQIEVVGDGVDAVELTNRLRKKVGYAEIVSVAAVGEKKEEKKPEAVVQPVLWSMYGGGVPQTYIHPIHPPNYYQDPSCSIM

SEQ ID NO: 491 - DNA, 667 bp, Gossypium hirsutum
  misc_feature 1..667: note = Ceres Clone ID no. 1839543
  misc_feature 1..667: note = Encodes the peptide sequence at SEQ ID NO. 492
  source 1..667: mol_type = other DNA
aaaacagcacaagtagttcctctctcgatattttccacatttctgccactctctttaggaaaactaaaacagctctgttcttgacaccatgaagcaaacgatggtagtgaaggtgactatgagcgacgagaaatcccgctccaaggccttgaaggtagtagtcggtttctcaggggtggagtcagcttcattgaaaggagatgacaagagccaaatagaggtaacaggagatggggtggacgcagttcagctaacaagtcggctaaggaagagcgtggggcatgcggagctagtgagcgttagtgctgtcggcggtgaaaagaaggaagaggccaaggagccccccgccgcctatgtatggccttataatcagcctttatatgtgtatcaagagttgccatatgctcatcaacaagacccttgctccatcatgtgaggtattttattacaagggaaacccataaaaccaatcccacacctccatccgtggcctttaattgatcccacaactgatgagctgggagaaatttattactttttatctttgcagttcatgatatatatatatatacgtgaggaagggcttccatgtgttgtacaattatagccggttaatttctttagtgagttctcatgttctcgtctgtatttcatcctatgttttctc

SEQ ID NO: 492 - protein, 115 aa, Gossypium hirsutum
  REGION 1..115: note = Ceres Clone ID no. 1839543
  REGION 1..115: note = Bit score of 276.0 for HMM based on sequences of Figure 1
  REGION 1..115: note = Functional Homolog Of SEQ ID NO. 483
  REGION 1..115: note = Figure 1
MKQTMVVKVTMSDEKSRSKALKVVVGFSGVESASLKGDDKSQIEVTGDGVDAVQLTSRLRKSVGHAELVSVSAVGGEKKEEAKEPPAAYVWPYNQPLYVYQELPYAHQQDPCSIM

SEQ ID NO: 493 - protein, 77 aa, Medicago truncatula
  REGION 1..77: note = Public GI ID no. 124360895
  REGION 1..77: note = Bit score of 155.1 for HMM based on sequences of Figure 1
  REGION 1..77: note = Functional Homolog Of SEQ ID NO. 483
  REGION 1..77: note = Figure 1
MKQKIVMRVHMRCQKCRTKALEVVAGANGVNFVGLEGDEKDKIVVIGDGVDAVTLTKCLRKKVGQTEIVSLGEVKAS

SEQ ID NO: 494 - DNA, 658 bp, Panicum virgatum
  misc_feature 1..658: note = Ceres Clone ID no. 1778664
  misc_feature 1..658: note = Encodes the peptide sequence at SEQ ID NO. 495
  source 1..658: mol_type = other DNA
aagcagcgatcgcacaccagaccagagtgctcagcgatccaaccaatccgacagccatcagcggcgtcagccaagcctccgcgccgaccggatccttctcagcgggcggcacgccatgaccaagcaaaagatcgtgatcagggtgagcctggcgagcgagaagacccggtccaaggccatggcgctggtcgccaaagcggacggggtgagctcgatgggggtcaccggcgacggcagggaccagctggaggtggtcggcgacggcgtcgacaccgtctgcctggtccagtgcctgcgcaagaagatcggccacgccgagatcctcaaggtggaggaggtgaagccggccgacaagaaacccgaggagaagaagcccgacgacaagaagccggagccgctgccgtactggtggtaccacaattactaccactaccacccgcagccgccgtgctggtgaggtggccctggtggtcgccactcgccaggcagccgttcatggaagcggcggccgtttttgatggattactagttgggaattggaattctgctcatgctcgccttatatgtgtattcgagctgctctgtatttgagtgaaaacagaaaaaaaaggcaaaaggctgctacttgtccatatttgatctgttttcagtttcaccc

SEQ ID NO: 495 - protein, 113 aa, Panicum virgatum
  REGION 1..113: note = Ceres Clone ID no. 1778664
  REGION 1..113: note = Bit score of 260.1 for HMM based on sequences of Figure 1
  REGION 1..113: note = Functional Homolog Of SEQ ID NO. 483
MTKQKIVIRVSLASEKTRSKAMALVAKADGVSSMGVTGDGRDQLEVVGDGVDTVCLVQCLRKKIGHAEILKVEEVKPADKKPEEKKPDDKKPEPLPYWWYHNYYHYHPQPPCW

SEQ ID NO: 496 - DNA, 626 bp, Panicum virgatum
  misc_feature 1..626: note = Ceres Clone ID no. 2030878
  misc_feature 1..626: note = Encodes the peptide sequence at SEQ ID NO. 497
  source 1..626: mol_type = other DNA
caaagaaaacatcgatcggagtaagcaagccaagccacccgatcagcctcgctctaccgatccaatttgtttccccagctcctctttttcgcctcaggaggtagcggacgccagaaaccagcagctagttagcacgctgcgatgaagcaaaagatcgtgatcaaggtgagcatggcgtccgagaagagccggtccagggccatggagctcgtcgctagagcagacggggtgagctcgatgggggtcaccggcgccggcagggaccagctggaggtggtcggcgacttcgtcgacaccgtctgcctggtcaagtgcctgcgcaggaagctcggccaggccgacatcctcaaggtggaggaggtgaaggacaagaagcccgaggagaagaagccggaggagcccaagattatcgcggacccgccgccgtactattaccccggttactactaccaccagcacatgccagcaccgtggtggtgacgatagaaacgcgaaggaaacagctagtttttgtatttatttgattcaaattcgttccacactcgtttttgctactgttctgtgtgaggggaaagttataagaaacagtattgctattgtgcatccgtttgaaattttggttcttt

SEQ ID NO: 497 - protein, 112 aa, Panicum virgatum
  REGION 1..112: note = Ceres Clone ID no. 2030878
  REGION 1..112: note = Bit score of 211.9 for HMM based on sequences of Figure 1
  REGION 1..112: note = Functional Homolog Of SEQ ID NO. 483
MKQKIVIKVSMASEKSRSRAMELVARADGVSSMGVTGAGRDQLEVVGDFVDTVCLVKCLRRKLGQADILKVEEVKDKKPEEKKPEEPKIIADPPPYYYPGYYYHQHMPAPWW

SEQ ID NO: 498 - protein, 122 aa, Oryza sativa
  REGION 1..122: note = Public GI ID no. 115458882
  REGION 1..122: note = Bit score of 234.9 for HMM based on sequences of Figure 1
  REGION 1..122: note = Functional Homolog Of SEQ ID NO. 483
  source 1..122: note = Oryza sativa subsp. japonica
MKQKIVIKVSMPCEKSRSKAMKLVVMASGVSSVEVTGDGKDRLQVVGDGVDAACLVTCLRKKIGHAELVQVEEVKEKKPEEKKPEEKKPEPCYCPHPCYYHHHYGGIPVAVGDQPSDPCSIM

SEQ ID NO: 499 - DNA, 336 bp, Sorghum bicolor
  misc_feature 1..336: note = Ceres Annot ID no. 8701404
  misc_feature 1..336: note = Encodes the peptide sequence at SEQ ID NO. 500
  source 1..336: mol_type = other DNA
atgaagcaaaagatcgtgatcaaggtcagcatgtcgtcagagaagagccggtccaaggccatggcacttgtcgccagagccgacggggtcagctcgatggggatcgtcggcgacggcaaggaccggctggaggtggtcggcgtggacgtcgacaccgtctgcctggtcacgtgcctgcgcaagaagctcggccacgctgacatcctgctggtggatgaagtcaaggacaagaaggcggaggagaagaagcagccggagaaacccaaggtcgtggaactgccgccgtattactgcccctgttattacggttactactgccactaccaccaccactga

SEQ ID NO: 500 - protein, 111 aa, Sorghum bicolor
  REGION 1..111: note = Ceres Annot ID no. 8701404
  REGION 1..111: note = Bit score of 184.1 for HMM based on sequences of Figure 1
  REGION 1..111: note = Functional Homolog Of SEQ ID NO. 483
MKQKIVIKVSMSSEKSRSKAMALVARADGVSSMGIVGDGKDRLEVVGVDVDTVCLVTCLRKKLGHADILLVDEVKDKKAEEKKQPEKPKVVELPPYYCPCYYGYYCHYHHH

SEQ ID NO: 501 - protein, 118 aa, Oryza sativa
  REGION 1..118: note = Public GI ID no. 115458830
  REGION 1..118: note = Bit score of 287.4 for HMM based on sequences of Figure 1
  REGION 1..118: note = Functional Homolog Of SEQ ID NO. 483
  source 1..118: note = Oryza sativa subsp. japonica
MQQKIVIKVSMPCEKSRSKAMALVARASGVNSMEVTGDGKDRLQVVGDGVDPVCLVACLRRKIGYAEIVQVEEVKDKKPEEKQPEPPKPVPCYYPAPPCYYPPATVVCSDEPSPCSIM

SEQ ID NO: 502 - DNA, 465 bp, Sorghum bicolor
  misc_feature 1..465: note = Ceres Annot ID no. 8701387
  misc_feature 1..465: note = Encodes the peptide sequence at SEQ ID NO. 503
  source 1..465: mol_type = other DNA
atggccgaactgcatgctcgctccactgcaggtccgagtgtcaagttttggatctccagtgacccgtaccaccactcaaagctgcaaaagatggtgatcaaggtgagcatgccgtgcgagaggagccggtccaaagccatgacgcttgccgccagagcagatggggtgatatcgatggcgatcaccggcgacgcgagggagaagctggaggtggtcggcgacggcgtcgacccggtcaggctggtcagctgcctgcgcaggaaggtcggccacgccgagatcctgcaggtggaggaagtgaaggacaagaagcccgaggagaagaagaagccggaggagcccaagccgccgcagcccgtggccgtgcacccgccgccgcattgctatcccggaggctaccactactaccgccacccgccgccgatggtcgtctgcgaggagccgagcggttgccccatcatgtaa

SEQ ID NO: 503 - protein, 154 aa, Sorghum bicolor
  REGION 1..154: note = Ceres Annot ID no. 8701387
  REGION 1..154: note = Bit score of 195.7 for HMM based on sequences of Figure 1
  REGION 1..154: note = Functional Homolog Of SEQ ID NO. 483
MAELHARSTAGPSVKFWISSDPYHHSKLQKMVIKVSMPCERSRSKAMTLAARADGVISMAITGDAREKLEVVGDGVDPVRLVSCLRRKVGHAEILQVEEVKDKKPEEKKKPEEPKPPQPVAVHPPPHCYPGGYHYYRHPPPMVVCEEPSGCPIM

SEQ ID NO: 504 - protein, 132 aa, Oryza sativa
  REGION 1..132: note = Public GI ID no. 116310418
  REGION 1..132: note = Bit score of 216.0 for HMM based on sequences of Figure 1
  REGION 1..132: note = Functional Homolog Of SEQ ID NO. 483
  source 1..132: note = Oryza sativa subsp. indica
MKQKMVIKVSMPCGKCRSKAMALVAGATGVSSVEVTGDGKDRLQVVGDGVDPVCVVNRLRKKIGHAEIVQVEEVKEKKPDLPKKPDPPKPEPPKPPVVCYPPTPYYHHHYGGPPPPVVFCDQPSPNGTCSIM

SEQ ID NO: 505 - DNA, 384 bp, Sorghum bicolor
  misc_feature 1..384: note = Ceres Annot ID no. 8679943
  misc_feature 1..384: note = Encodes the peptide sequence at SEQ ID NO. 506
  source 1..384: mol_type = other DNA
atggccaagcaaaagatcgtgatcaaggtgccgatgtcgagcgacaagtcgcggtccaaggccatggcgctggtggcggcggcgggcggggtacactcggtggccatcgccggcgacggcaaggaccaggtcgtcgtcgtcggcgagggcgtcgactccatcaagctcaccaccgacctgcgcaagaagatgggcgacgcgcagctcgtcgaggtcggagaggacaagaagaaggaggagaagacgaagcccgaccccgtcgccgacgctgtggcagcctactacaacagccagtactactaccactacccgccgccgccgccggcggtcgccgtcgcctacgacccctactcgcggccgggcagcacctgctccataatgtag

SEQ ID NO: 506 - protein, 127 aa, Sorghum bicolor
  REGION 1..127: note = Ceres Annot ID no. 8679943
  REGION 1..127: note = Bit score of 259.1 for HMM based on sequences of Figure 1
  REGION 1..127: note = Functional Homolog Of SEQ ID NO. 483
MAKQKIVIKVPMSSDKSRSKAMALVAAAGGVHSVAIAGDGKDQVVVVGEGVDSIKLTTDLRKKMGDAQLVEVGEDKKKEEKTKPDPVADAVAAYYNSQYYYHYPPPPPAVAVAYDPYSRPGSTCSIM

SEQ ID NO: 507 - DNA, 402 bp, Sorghum bicolor
  misc_feature 1..402: note = Ceres Annot ID no. 8701391
  misc_feature 1..402: note = Encodes the peptide sequence at SEQ ID NO. 508
  source 1..402: mol_type = other DNA
atgaagcaaaagacggtgatcaaggtgagcatgccgtgcgataggagccggtccaaagccctgacgctggccgcccgagcagacggggtaatctccgtggagatcaccggcggcgacaaggacaagctggaggtggtcggcgacggcgtcgacacggtctgcttggtcagctgcctgcgcaggaagctcggccacgccgacatcctgcaggtggaggaagtgaagcccgatgacccgacgaacaaggagtcgccggacgggccgacgccgccgcccgagccagtaccgccgccgccgcatccagactacacctacacggattgctgctgctgctgccaccaccaccacccgccaccgccaatggtcatctgcgaggaaccaagcaattgcgccgtcatgtaa

SEQ ID NO: 508 - protein, 133 aa, Sorghum bicolor
  REGION 1..133: note = Ceres Annot ID no. 8701391
  REGION 1..133: note = Bit score of 170.8 for HMM based on sequences of Figure 1
  REGION 1..133: note = Functional Homolog Of SEQ ID NO. 483
MKQKTVIKVSMPCDRSRSKALTLAARADGVISVEITGGDKDKLEVVGDGVDTVCLVSCLRRKLGHADILQVEEVKPDDPTNKESPDGPTPPPEPVPPPPHPDYTYTDCCCCCHHHHPPPPMVICEEPSNCAVM

SEQ ID NO: 509 - protein, 119 aa, Oryza sativa
  REGION 1..119: note = Public GI ID no. 46806257
  REGION 1..119: note = Bit score of 198.1 for HMM based on sequences of Figure 1
  REGION 1..119: note = Functional Homolog Of SEQ ID NO. 483
  source 1..119: note = Oryza sativa subsp. japonica
MAKQKIVIKMNMASDKCRSKAMALVASTTGVDSVALAGDGKDQLVVVGDGVDSIELTTALRKKVGHATLMTVGEDKKEEKKPEPAVVEYPYPWNCYPYGYAPPPQHVVYQYPASSSWWW

SEQ ID NO: 510 - protein, 118 aa, Oryza sativa
  REGION 1..118: note = Public GI ID no. 125540058
  REGION 1..118: note = Bit score of 209.4 for HMM based on sequences of Figure 1
  REGION 1..118: note = Functional Homolog Of SEQ ID NO. 483
  source 1..118: note = Oryza sativa subsp. indica
MAKQKIVIKVNMASDKCRSKAMALVASTSGVDSVALAGDSKDQVVVVGDGVDSIKLTTALRKKVGHATLMTVGEVKKEEKKPEPAAVVEYPWSYHPYTFAPPAQHVVYQYPASSWSIF

SEQ ID NO: 511 - DNA, 628 bp, Triticum aestivum
  misc_feature 1..628: note = Ceres Clone ID no. 1018979
  misc_feature 1..628: note = Encodes the peptide sequence at SEQ ID NO. 512
  source 1..628: mol_type = other DNA
acaaaaccatcacaagctagtactasacaccgagacagcccttggaagatcgatcagtagctaccaaaaccaatttcgattttagcctcgcttgaacgcggacattttccgagtttctatttctcattgatagggagcatcygccaaaccagcagcacgcaaaatgaagcaaagattgtcatccaattgagcatgtcgtgcgacaaacgccggtcgaaagcactgacgctggcctccagagcagccggggtgacgtcgatgggcataaccggcgacgccagggaccagctggaggtggtcggtgacggcgtcgacccggtgtgcctcgtcagctgcctccgcaagaaactcggccacgcccacatcatcaaggtagaggaagtgaagaagccggaggagaagaagaagccggtgaaccccccgcagtactactactcgccggcgccggccggctactaccaccaccaatacccgccgcacatggtcgtctgcgaggaacagcctagcaactgccggaccatgtaactgccagagaacgattttgacgtagtactttaattttgtcagcaactatagttgcatacatgtacttgtaaattaattggaggaagaaataaaaaggagaaag

SEQ ID NO: 512 - protein, 110 aa, Triticum aestivum
  REGION 1..110: note = Ceres Clone ID no. 1018979
  REGION 1..110: note = Bit score of 158.6 for HMM based on sequences of Figure 1
  REGION 1..110: note = Functional Homolog Of SEQ ID NO. 483
MSCDKRRSKALTLASRAAGVTSMGITGDARDQLEVVGDGVDPVCLVSCLRKKLGHAHIIKVEEVKKPEEKKKPVNPPQYYYSPAPAGYYHHQYPPHMVVCEEQPSNCRTM

SEQ ID NO: 513 - DNA, 959 bp, Panicum virgatum
  misc_feature 1..959: note = Ceres Clone ID no. 1725423
  misc_feature 1..959: note = Encodes the peptide sequence at SEQ ID NO. 514
  source 1..959: mol_type = other DNA
agctagtagccagctccttctcaagttacacgaagactcggtgtagtatcgtaggcagagttataagtcaaacagtgctcgatcagttatttcctcagcttctgatcagtatagtcgtcgttcgtgaaccaaatattttgaagcggttcggtagtcagcgatggcaaagcagaagatcgtgatcaagatgaccatgcccaccgccaagagccgtgctcgggccatggcgctggccgccagggcgagcggggtggggtcgatagggatcaccggcgacctcaaggatcggctggaggtggtcggcgagggcatcgacatcacctgcctcgtccactgcctgcgcaagaaggtctgctgccacgccgagatcctgcaggtggaggaggtcaaggacaagaagcccgagaagaagaagcccgaggaggagaagaagccctgcccgtgcccagggccgtgccggtgcgccgccgtcggctactgccacgcgccgatgccgatggttctctgcgaggacccgccggagggcatctgccgcgtcatgtgaagctagcagtaagatgatggatctcgccatgcatttgtatttgtgatttgacttctcaactcgatcttgctgccacaacacacagcttcttcatacgtgtgtgtcagtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgcaaacgaggttctggtttcctttcgctaagcttccgccaaccatgcatcgacagtgtaactagctagatcactacaagctagcgtgtatgttatatgtgtgcatgtacttgttgagttggtcacgttgtatccatccagttgtgaacttgatgcaaagattgttattatatttaat

SEQ ID NO: 514 - protein, 127 aa, Panicum virgatum
  REGION 1..127: note = Ceres Clone ID no. 1725423
  REGION 1..127: note = Bit score of 155.7 for HMM based on sequences of Figure 1
  REGION 1..127: note = Functional Homolog Of SEQ ID NO. 483
MAKQKIVIKMTMPTAKSRARAMALAARASGVGSIGITGDLKDRLEVVGEGIDITCLVHCLRKKVCCHAEILQVEEVKDKKPEKKKPEEEKKPCPCPGPCRCAAVGYCHAPMPMVLCEDPPEGICRVM

SEQ ID NO: 515 - protein, 121 aa, Oryza sativa
  REGION 1..121: note = Public GI ID no. 115446965
  REGION 1..121: note = Bit score of 217.1 for HMM based on sequences of Figure 1
  REGION 1..121: note = Functional Homolog Of SEQ ID NO. 483
  source 1..121: note = Oryza sativa subsp. japonica
MAKQKIVIKVEMSCDKCRSKAMALVAATGGVDSVALAGDGKDQVVVVGDGVDSIKLTAALRKKVGHATLVTVGEVKKEEKKPEPAAAAVEYPWSYHPAYTYAPPAQHVFYQQYPASSPWWC

SEQ ID NO: 516 - protein, 121 aa, Oryza sativa
  REGION 1..121: note = Public GI ID no. 125540059
  REGION 1..121: note = Bit score of 212.5 for HMM based on sequences of Figure 1
  REGION 1..121: note = Functional Homolog Of SEQ ID NO. 483
  source 1..121: note = Oryza sativa subsp. indica
MAKQKIVIKVEMSCDKCRSKAMALVAATGGVDSVALAGDGKDQVVVVGDGVDSIKLTAALRKKVGHATLVTVGEVKKEEKKPEPATAAVVEYSWSYHPYAYAPPAQHVVYQQYPASSPWWC

SEQ ID NO: 517 - protein, 150 aa, Oryza sativa
  REGION 1..150: note = Public GI ID no. 38606531
  REGION 1..150: note = Bit score of 177.2 for HMM based on sequences of Figure 1
  REGION 1..150: note = Functional Homolog Of SEQ ID NO. 483
  source 1..150: note = Oryza sativa subsp. japonica
MKQKMVIKVSMPCGKCRSKAMALVAGATGVSSVEVTGDGKDRLQVVGDGVDPVCVVNRLRKKIGHAEIVQVEEVKEKKPDLPKKPDPPKPEPPKPPVRRGFPGPHEPEKIHRASLLLSGQEAGRLQQLQLWLRIVSAALFMSAVAQLRRQ

SEQ ID NO: 518 - DNA, 767 bp, Panicum virgatum
  misc_feature 1..767: note = Ceres Clone ID no. 1955791
  misc_feature 1..767: note = Encodes the peptide sequence at SEQ ID NO. 519
  source 1..767: mol_type = other DNA
accacagcaaagcgagcagttgcgagacacgggcctctcctctccactccggctctatctccataccaacgatctctcgacagccgcgaggcgtttgagctttcctttccaatccaagcttggagcaccgcgcgggcacgagagttcaggcatggcgaagcaaaagatcgtgatcaaggtgcagatggcgagcgaccggtgccggtcccgggcgatggcgctggtggcggccacgggcggggtggactccgtggcgctcgccggcgacggcaaggaccaggtcgtcgtggtgggcgagggcgtcgactccatcaagctcaccaccgcgctgcgcaagaagttgggcggcgcggagctgctgcaggtcggcgaggacaaggaggaggagaagaagccggcgccggcccccgcccccgccgcggtggctgcggcggccgagtactactcccagttgtactaccaccactacccgccgccgcacctggccggcgccgtccacgaccaccgcgccgtcgggtacgggggctactcgcgggcggacacctgctccataatgtaaacagaggggtttggattgccgttcaaagtttgtgttgtagttcaggatgcaagtttcattgggtcaacccaactacccattatccaatttaccaaaaaatagtgtaattaccttatagagtcaacccactaaattttggtgctagtttgggtttaccctgtgggtaattgggtaacccaaaatttatcgaatcttttgttgagggtcc

SEQ ID NO: 519 - protein, 135 aa, Panicum virgatum
  REGION 1..135: note = Ceres Clone ID no. 1955791
  REGION 1..135: note = Bit score of 187.6 for HMM based on sequences of Figure 1
  REGION 1..135: note = Functional Homolog Of SEQ ID NO. 483
MAKQKIVIKVQMASDRCRSRAMALVAATGGVDSVALAGDGKDQVVVVGEGVDSIKLTTALRKKLGGAELLQVGEDKEEEKKPAPAPAPAAVAAAAEYYSQLYYHHYPPPHLAGAVHDHRAVGYGGYSRADTCSIM

SEQ ID NO: 520 - DNA, 579 bp, Panicum virgatum
  misc_feature 1..579: note = Ceres Clone ID no. 2032166
  misc_feature 1..579: note = Encodes the peptide sequence at SEQ ID NO. 521
  source 1..579: mol_type = other DNA
acaccacagcagagcaagcagttgcgagacacgggcctctcctctcctctccactccggctctatccccataccaacgatctcgactctcgagttctcgacagccgcgcggccccgagagttcaggcatggcgaagcaaaagatcgtgatcaaggtgcagatggcgagcgaccggtgccgggcccgggcgatggcgctggtggcggccacgggcggggtggactccgtggtgctcgccggcgacggcaaggaccaggtcgtcgtcgtcggggagggcgtcgactccatcaagctcaccagcgcgctgcgcaagaaggtgggcggcgcggagctgctgcaggtcggcgaggacaagaaggaggagaagaagccggcgccggtgccggaccccgccgccgccgccgcggcagcggccgagtactacagccagctgtactaccaccactacccgccgccgcacccggccggcgccgtctacgaccaccgcgccgccgggtacggctactactcgcgggcggacacctgctccataatgtaatcggatgggcttgggattgccggtgaagtttgtgttctagt

SEQ ID NO: 521 - protein, 136 aa, Panicum virgatum
  REGION 1..136: note = Ceres Clone ID no. 2032166
  REGION 1..136: note = Bit score of 193.3 for HMM based on sequences of Figure 1
  REGION 1..136: note = Functional Homolog Of SEQ ID NO. 483
MAKQKIVIKVQMASDRCRARAMALVAATGGVDSVVLAGDGKDQVVVVGEGVDSIKLTSALRKKVGGAELLQVGEDKKEEKKPAPVPDPAAAAAAAAEYYSQLYYHHYPPPHPAGAVYDHRAAGYGYYSRADTCSIM

SEQ ID NO: 522 - protein, 109 aa, Oryza sativa
  REGION 1..109: note = Public GI ID no. 125540060
  REGION 1..109: note = Bit score of 164.4 for HMM based on sequences of Figure 1
  REGION 1..109: note = Functional Homolog Of SEQ ID NO. 483
  source 1..109: note = Oryza sativa subsp. indica
MAQKIVIKVHMGSDKCRRKAMALVAATGGVVSVELAGDDRSKVVVVGEVDSVKLTSLLRRKVGPAELVEVGDAKPAKKEEKKEEKKPETVPPYYYYYPYHHYSPYGYIM

SEQ ID NO: 523 - protein, 109 aa, Oryza sativa
  REGION 1..109: note = Public GI ID no. 46806261
  REGION 1..109: note = Bit score of 162.4 for HMM based on sequences of Figure 1
  REGION 1..109: note = Functional Homolog Of SEQ ID NO. 483
  source 1..109: note = Oryza sativa subsp. japonica
MAQKIVIKVHMGSDKCRRKAMSLVAATGGVVSVELAGDDRSKVVVVGEVDSVKLTSLLRRKVGPAELVEVGDAKPAKKEEKKEEKKPETVPPYYYYYPYHHYSPYGYIM

SEQ ID NO: 524 - DNA, 526 bp, Panicum virgatum
  misc_feature 1..526: note = Ceres Clone ID no. 100178733
  misc_feature 1..526: note = Encodes the peptide sequence at SEQ ID NO. 525
  source 1..526: mol_type = other DNA
gaggtggccaaactcgagtctacacaatgaaaaagattgtaatcaagattagtatgatcagcgatcggagcagagctaaggctatggagttactcgccaaggctaacggagtgtcatcgattgggatagttggggacgggagggacaggctggaggtggtcggcgacggcatggacgccttctgccttgtaaaatgcctgcgcaaggagctgggccacgcggaactcctgatgatgggggatgtcaaggacaaagaggcacggccggagccggtggtggtggtgaacaccgaagaggcgcgtcctgcagacgacaagccggccagcaggcggcggcgtttccgggaaaattttaccaaattattacccaaattcgtgtggtcgcgcactcgcacaagtatttctcctccagcactatcgccggctgcatcccatctcttcccggatgtgttgccgtcctccacagccgtcgtcagcacggcctcgccgccctccagggcggtggatccactgctcccgcccgtgag

SEQ ID NO: 525 - protein, 166 aa, Panicum virgatum
  REGION 1..166: note = Ceres Clone ID no. 100178733
  REGION 1..166: note = Bit score of 120.5 for HMM based on sequences of Figure 1
  REGION 1..166: note = Functional Homolog Of SEQ ID NO. 483
MKKIVIKISMISDRSRAKAMELLAKANGVSSIGIVGDGRDRLEVVGDGMDAFCLVKCLRKELGHAELLMMGDVKDKEARPEPVVVVNTEEARPADDKPASRRRRFRENFTKLLPKFVWSRTRTSISPPALSPAASHLFPDVLPSSTAVVSTASPPSRAVDPLLPPV

SEQ ID NO: 526 - DNA, 689 bp, Zea mays
  misc_feature 1..689: note = Ceres Clone ID no. 351547
  misc_feature 1..689: note = Encodes the peptide sequence at SEQ ID NO. 527
  source 1..689: mol_type = other DNA
aagccgtacccctaccctcacatcacggagtgctcagttagcaatagagcaagccatccaattcacagaggacagagcaagccatccaattcacagaggacagagcaagccatccaattcacagaggacagagcaagccatcaccgcgcgggaagcaatgaagcaaaagatcgtgatcaaggtgagcatgccgtgccagaggagccggaccaaagccatgacgctggccgccggagcaaacggggtgatatcggtggcgatcgccggggagaagctggaggtggtcggcgacgacgtcgacccggtcaggctggccagctgcctgcgcaggaaggtcggccacgccgacatcctgcacgtggaggaagtcaaggacaagaagccgcccgaggaccccaagccgccgccgccgccggcgccgccggcgccgcagcccgtggtcgtgcacccgccgccgccgcactggccgcactgctaccccggaggctaccaccaccaccacccgccgccgccgccggtggtcgtctgtgacgagcccagcggctgccacatcatgtaattagaacggctgacatgaatagctgaggtcgattttttttgtcatgtaggtacagttcttttcagcaacttgaggttaattgagggagctatgaactatttgtgcaaataaagtttactttttttgcggc

SEQ ID NO: 527 - protein, 133 aa, Zea mays
  REGION 1..133: note = Ceres Clone ID no. 351547
  REGION 1..133: note = Bit score of 159.5 for HMM based on sequences of Figure 1
  REGION 1..133: note = Functional Homolog Of SEQ ID NO. 483
MKQKIVIKVSMPCQRSRTKAMTLAAGANGVISVAIAGEKLEVVGDDVDPVRLASCLRRKVGHADILHVEEVKDKKPPEDPKPPPPPAPPAPQPVVVHPPPPHWPHCYPGGYHHHHPPPPPVVVCDEPSGCHIM

SEQ ID NO: 528 - DNA, 1723 bp, Panicum virgatum
  misc_feature 1..1723: note = Ceres Clone ID no. 1906874
  misc_feature 1..1723: note = Encodes the peptide sequence at SEQ ID NO. 529
  source 1..1723: mol_type = other DNA
gagcgcggccgcaaggtcctaggaggagctagctatactactcatcaagcagcttgcattgcgtgcgtggttgctgctgcaccggccggcaggagaacattacgtacgatcggcgattcagcgtcgtagagcgagagctagctatccacgcccccacccccagtcagatcaatcagttacttatttattcttcagcttaattctcgatcagtgtcgtcgtcggagaaccatcaacgatggccaagcacaagattgtgatcaaggtgaccatgccgaacgccaagagccgcgccggggccatggtgctggccgccaaaacgaacggggtgatctcgatagcaatcgccggcgacctcaaggaccggctggaggtggtcggcgagggcatcgacatcacctgcctcgtccactgcctgcgcaagaaggtctgccgccacgccgagatcctcaaggtggaggaggtcaaggacaagaagcccgaggaggagaagaagaagaagccggagccctgcgggtgcccggcgccgtgcctgtgcgcggcggcttatcaccagacgccgctgcaggttttcagctgcgaggagtcgccggcattcggttgcaacatcttgtgaagctagctcaaggttcaccttaccgacggtaaagcgattttcgccaactagcggtatcggtaaaccggcggtaaatcgccggaaaccgctagaaaccgctcgaaatgacaattcaaattcaaaaaaccggtaaccgatgtttaccgaccggtaaccgatgtttaccgaccggtaaccgtcgtttttaaccggtaaacaccgtatgactttggaaaattaaaaattttggcagcatttcaccgtaattttgtaaatatcattactgatggtatatatcaaacaattatataacatttacacatacatagaatagaagttcatatccataaaaatagaaattcacatccatagtccatatagatcatcacaacaatagtcaatgcaaatcatcacaaccatagtcctcacaaaccatcatcgtcaatatatataatacatagtagtggtttccggtccaaatgaacaaatgaacaaatgaaaatatatgtacatatttgaaatatgaacacacatatatacatatagctaaaatgaacaaattaacatccaactaccatgaacaaatggatccatatagctaatatgaacacatgtttttgaatatagctacacaacaaacatctaaaaatcaatgtaaaatcaagaaatactcacaatgcagtggtttccggtccaaatgcgccgatttccgctcggaaaacgcagaataccgctcgggattagaggataccgctcgggattaccggtccgaaagtatttttatttttttgagtgcccaaacagtcaaatatttgaacatgttctatattagaatgatgtatgtcatctctactttcttaccatattttttcttttttatttcaaatatttttgaaaattttaaattcgggcgaaattttttgaaatttaccgccggtatgggttgccgcctagtagcggtatcggtaaaaatcggcggtaaccgcccgttaccgatcggtaaggaaaacactgagctagctactagtaagttaattgaactcggtcacgcgtgcatctagcatctgtcgtcagcttcttcgtgcatgcgtcaagtgtaccatggttctatatatggtttgctttcgctt

SEQ ID NO: 529 - protein, 125 aa, Panicum virgatum
  REGION 1..125: note = Ceres Clone ID no. 1906874
  REGION 1..125: note = Bit score of 146.5 for HMM based on sequences of Figure 1
  REGION 1..125: note = Functional Homolog Of SEQ ID NO. 483
MAKHKIVIKVTMPNAKSRAGAMVLAAKTNGVISIAIAGDLKDRLEVVGEGIDITCLVHCLRKKVCRHAEILKVEEVKDKKPEEEKKKKPEPCGCPAPCLCAAAYHQTPLQVFSCEESPAFGCNIL

SEQ ID NO: 530 - DNA, 766 bp, Zea mays
  misc_feature 1..766: note = Ceres Clone ID no. 273420
  misc_feature 1..766: note = Encodes the peptide sequence at SEQ ID NO. 531
  source 1..766: mol_type = other DNA
aagcgggcaggcggcagcgcaaaacattaaaaccatcatttgcagcggcggctgctgccggcgacgcgatgtccaagcaaaagtccgtgatcaggctgggcgtaccgaacgacaagaaccggtctaaggccatgcagatggcatccaagtttgtgggagtgaactcggtggggatcgccggcgacgccaaggaccggctggaggtggtgggggagagcgtcgacatcacctgcatgatcaacctgctgcgcaagaaggtctgccgcgccgacatcgtcgtggtggaggaggtcaaggacaagaagaaggaggaggaggagaagaagaagaaggaggaggaagagaaaaagaagaaggcggaggaggaagccaagaagaagaaggaggaggaagagctcaagaagaagctctgcccgtacccgtacccgccgccgccgtgctccggtgcctgttgccgcgggccgtcgccgccgatgtttctgtgcgagccggaacagccagcgggctgccacatcatgtgacgatgaagtgaagctccttagtgctcaagatggatcctgcctgcctgggctcaacaatatgcatgcttgtgattttggtttgccacacatcatcgaccggtcagtttcactccgtgaataatcgtcccgtccgaacttgtgcacatgcgtggttgtggttttgctttggcatctgaattacaatcctaagtgatcatggaatttagatcactactatatatatatatatataagtatttttttgg

SEQ ID NO: 531 - protein, 150 aa, Zea mays
  REGION 1..150: note = Ceres Clone ID no. 273420
  REGION 1..150: note = Bit score of 107.7 for HMM based on sequences of Figure 1
  REGION 1..150: note = Functional Homolog Of SEQ ID NO. 483
MSKQKSVIRLGVPNDKNRSKAMQMASKFVGVNSVGIAGDAKDRLEVVGESVDITCMINLLRKKVCRADIVVVEEVKDKKKEEEEKKKKEEEEKKKKAEEEAKKKKEEEELKKKLCPYPYPPPPCSGACCRGPSPPMFLCEPEQPAGCHIM

SEQ ID NO: 532 - DNA, 465 bp, Sorghum bicolor
  misc_feature 1..465: note = Ceres Annot ID no. 8701399
  misc_feature 1..465: note = Encodes the peptide sequence at SEQ ID NO. 533
  source 1..465: mol_type = other DNA
atgtccaagcaaaagactgtgatcaggctgggcgtacccaacgccaagaaccggtctaaagccatgcagctcgcatccaaagctgtcggagtgaactcggtggccatcgccggcgaagccaaggaccagctggaggtggtaggagaaagcgtcgacatcacctgtctgatcaatcacctgcgcaagaaggtctgccgcgccgacatcgtcgtggtggaggaagtgaaggacaagaagaaggaggaggaggagaagaagaagaaggaggaagaagccaagaagaagaaggcggaggaagataagaagaaggcggaggaagcaaggaagaaggcggaagaagagttcaagaagctctgggcggcgtgcccgccgccgccgtacaacggtggttattatagttaccccgggccgccggcgacgtttgtatgcgaggaacagccagcagcaggctgccacatcatgtga

SEQ ID NO: 533 - protein, 154 aa, Sorghum bicolor
  REGION 1..154: note = Ceres Annot ID no. 8701399
  REGION 1..154: note = Bit score of 103.0 for HMM based on sequences of Figure 1
  REGION 1..154: note = Functional Homolog Of SEQ ID NO. 483
MSKQKTVIRLGVPNAKNRSKAMQLASKAVGVNSVAIAGEAKDQLEVVGESVDITCLINHLRKKVCRADIVVVEEVKDKKKEEEEKKKKEEEAKKKKAEEDKKKAEEARKKAEEEFKKLWAACPPPPYNGGYYSYPGPPATFVCEEQPAAGCHIM

SEQ ID NO: 534 - protein, 130 aa, Oryza sativa
  REGION 1..130: note = Public GI ID no. 125540061
  REGION 1..130: note = Bit score of 144.2 for HMM based on sequences of Figure 1
  REGION 1..130: note = Functional Homolog Of SEQ ID NO. 483
  source 1..130: note = Oryza sativa subsp. indica
MVQKIVIKVHMSSDKCRRKAMALAASTGGVVSVELAGDDRSKVVVVGDVDSIGLTNALRRKVDGSAELVEVSDASKKKEEEAKKKEELVYYHHGYGYYHPGGVYHHHPGYGPHGCPCSCNPSPDSTCSIM

SEQ ID NO: 535 - protein, 133 aa, Oryza sativa
  REGION 1..133: note = Public GI ID no. 115446971
  REGION 1..133: note = Bit score of 143.8 for HMM based on sequences of Figure 1
  REGION 1..133: note = Functional Homolog Of SEQ ID NO. 483
  source 1..133: note = Oryza sativa subsp. japonica
MVQKIVIKVHMSSDKCRRKAMALAASTGGVVSVELAGDDRSKVVVVGDVDSIGLTNALRRKVDGSAELVEVSDASKKKEEEAKKKEEKEELVYYHHGYGYYHPGGVYHHHPGYGPHGCPCGCNPSPDSTCSIM

SEQ ID NO: 536 - DNA, 792 bp, Panicum virgatum
  misc_feature 1..792: note = Ceres Clone ID no. 1802499
  misc_feature 1..792: note = Encodes the peptide sequence at SEQ ID NO. 537
  source 1..792: mol_type = other DNA
tgctccagccaccaccacggcaacccagcaaggcgagctcctctggttcataactttcttcttcaccgacctcggcacacctccaccgagaacaagcaagttttcaagctctcgagcacaaaacctgtcgtggccgcagctggttggcaaccaacggtttcagaaatgaaggtggcactgtgcagcaaaagatcgtgatcaaggtgcagatgagctgcgacaagtgccgggccaaggcgatggcgctggtggcggcggccggcggcgtggactccgtggcgatcgccggcgccgacagggaccaggtcgtcgtcgtgggcgagggcgtcgactccatccacctcaccgccgcgctgcgcaggaaggtcgggcccgcgcacatcctgcaggtcggcgaggacaagaaggacgacaagaagaagccgccgccggcgccgcccgtgcccgactactacccgtggtgctacccgccgccgccgtcgcagccggccggcttcctctccgacccctacggctacgggtacgcctaccagacgcggcaagagagcagcggctgctccataatgtagattgtacatttgtatctgtacttgtagagagaaggcaacaatccacacatacgtacgtatgtacgggctagtatatgtacttgtagagagaaggcaacaatccacacatatacttctttttttttcaagggaatccatacatatacctgatacaaagattgtagttttcttttcttttctagcggtactctaatttgtgaatgaaactcttggattttcttgc

SEQ ID NO: 537 - protein, 119 aa, Panicum virgatum
  REGION 1..119: note = Ceres Clone ID no. 1802499
  REGION 1..119: note = Bit score of 127.5 for HMM based on sequences of Figure 1
  REGION 1..119: note = Functional Homolog Of SEQ ID NO. 483
MSCDKCRAKAMALVAAAGGVDSVAIAGADRDQVVVVGEGVDSIHLTAALRRKVGPAHILQVGEDKKDDKKKPPPAPPVPDYYPWCYPPPPSQPAGFLSDPYGYGYAYQTRQESSGCSIM

SEQ ID NO: 538 - DNA, 659 bp, Gossypium hirsutum
  misc_feature 1..659: note = Ceres Clone ID no. 1850157
  misc_feature 1..659: note = Encodes the peptide sequence at SEQ ID NO. 539
  source 1..659: mol_type = other DNA
gtcccatacaaaacacgtaacttcttcttcttccaaacatctttttgtcttcttctttcaaaaggtaacagataatcgccaccatgaagcaaaagatggtattgaaggtttccatgaatggcgacaaatcccgctccaaggcattgaaagttgcagttggtctctcaggggtggagtcggcttcgttgaaaggcgatgacaagagccaaatagaggtgacaggggatggtgtggatgcagttaagctagcaagtcagttaaggaagagcgtggggttcgccgagctggttagcgtcagtgccgccggtggcgaaaagaaggaagagaagaaagacgatcctaagccagagccaccgttctgctatgtgtcgccgccgtttaatccatcataccattattatccttcgtacgaatatgtcgacaactatggcccctcccccccttgctccatcatgtaatcacagacgcggaattttacacttcacagccgacaacaataaatgagacaaatatattacttggcttgagttcctcaaattttgtagctcataatcatgtcaaatttagagctcaaatcattgtgtttcatatgcaattctttttttgtttggttttcatttttttaaatatatatatttgaagaaagcttgtgttatagc

SEQ ID NO: 539 - protein, 124 aa, Gossypium hirsutum
  REGION 1..124: note = Ceres Clone ID no. 1850157
  REGION 1..124: note = Bit score of 210.9 for HMM based on sequences of Figure 1
  REGION 1..124: note = Functional Homolog Of SEQ ID NO. 483
MKQKMVLKVSMNGDKSRSKALKVAVGLSGVESASLKGDDKSQIEVTGDGVDAVKLASQLRKSVGFAELVSVSAAGGEKKEEKKDDPKPEPPFCYVSPPFNPSYHYYPSYEYVDNYGPSPPCSIM

SEQ ID NO: 540 - DNA, 973 bp, Zea mays
  misc_feature 1..973: note = Ceres Clone ID no. 1471240
  misc_feature 1..973: note = Encodes the peptide sequence at SEQ ID NO. 541
  source 1..973: mol_type = other DNA
ttcctcacaactgcggcttattagtaggccgcgcgcgctagctctcttggtctagctgtagttgcaccatcagcgcgcgaacggcggatcgatcagcttcgtctttcaattcttctccacatcatcatttgcgccacgtacgtaaatcggctgctgcgggagagacgaccggccgccggcgacgccgccatgaccaagcaaaaggcagtgatcaggcttggcgtaacgaacgaccagaaccggtctaaggccatgcagctggcgtcccgatttcacggagtgaccttggtgtcgatcaccggcgcaggcaaggaccagctggaggtggtaggagaagacatcgacatcccctgcctcgtcaattcgctgcgcaagaaggtctgccgctccgccggcatcgtcgtggtggaggaagtcaaggacaaggcgaaggtggaggaggagaagaagaagaaggaagaggaagagaagaagaagaaggccaaggagttgcaagaagcgctccagaagctctgcgcgtcgtcgccgtgcccgccgccgccgttctacggcggcccgacgtttctctgcgaggaacagccaacaggctgccacatcatgtgaagctgatggattctggcccggcctttatatatacgaatatatgcgtgtgcttttggttctgaacttttgccacaccgccggcccacctagtctccgtgaagcgtgtgcggagcggggcgtggcaaattctgaacatatattggtgctgtttttgaatttgcttgaaccatatcctgctggccagctttttttataagaactttttttgtattttcctataaacattaccgaatttaggatggtttgactccgaataaactcagaaatagttacatttatggaaggactggctacatgtatgtctacaagctagtatcgtcttactatctactacaactatcctataatataagaaattttgagtttcccc

SEQ ID NO: 541 - protein, 137 aa, Zea mays
  REGION 1..137: note = Ceres Clone ID no. 1471240
  REGION 1..137: note = Bit score of 101.2 for HMM based on sequences of Figure 1
  REGION 1..137: note = Functional Homolog Of SEQ ID NO. 483
MTKQKAVIRLGVTNDQNRSKAMQLASRFHGVTLVSITGAGKDQLEVVGEDIDIPCLVNSLRKKVCRSAGIVVVEEVKDKAKVEEEKKKKEEEEKKKKAKELQEALQKLCASSPCPPPPFYGGPTFLCEEQPTGCHIM

SEQ ID NO: 542 - DNA, 372 bp, Sorghum bicolor
  misc_feature 1..372: note = Ceres Annot ID no. 8679942
  misc_feature 1..372: note = Encodes the peptide sequence at SEQ ID NO. 543
  source 1..372: mol_type = other DNA
atgaagcaaaagatcgtgatcaaggtgcagatgagctgcgacaagtgccggtccaaggccctggccgtggtggcggccacgggcggcgtcgactccgtggcgatcgacggcgaaggcagggacaaggtcgtcgtcgtgggcgacgtcgactccgtcaagctcaccagcgcgctgcgcaagaaggtagggcccgcgcacctgctgcaggtcggcgaggccaagaaggacgacaagacgaagccgccggccgccgtcgtgcccgcttattattacccgccgccgcacccggtcaccgtcgtctacgaccaccctgccggctactcgtggtacggctaccaggcgcagcaagacaccagctgctccataatgtag

SEQ ID NO: 543 - protein, 123 aa, Sorghum bicolor
  REGION 1..123: note = Ceres Annot ID no. 8679942
  REGION 1..123: note = Bit score of 159.5 for HMM based on sequences of Figure 1
  REGION 1..123: note = Functional Homolog Of SEQ ID NO. 483
MKQKIVIKVQMSCDKCRSKALAVVAATGGVDSVAIDGEGRDKVVVVGDVDSVKLTSALRKKVGPAHLLQVGEAKKDDKTKPPAAVVPAYYYPPPHPVTVVYDHPAGYSWYGYQAQQDTSCSIM

SEQ ID NO: 544 - DNA, 732 bp, Arabidopsis thaliana
  misc_feature 1..732: note = Ceres Clone ID no. 1024049
  misc_feature 1..732: note = Encodes the peptide sequence at SEQ ID NO. 545
  source 1..732: mol_type = other DNA
attctaccaaacaagaaatctaagccaaaacattcaaagcgatttctcaagcaaaactagaagatgaagcaaaagatcttgataagagtgactatgaccgatgacaaaacccgagcaaaagcaatgacaaaagcagttcagtttaaaggcgtgtcagccgtggaaataaaaggcgatcacaggaaccagatagaggtaaccggcgttgaagttgatatgatccctcttatccaaatactcagaaagaaggtagcgttcgcagagcttgtgagcgtgaccaaagttgaaccaccaaagaaagaagacgagaagaaaggaggggacggaaagggtgcagagggaaaaggcggtgaccaaaaaggtggcgataataaagggccagatgacaaggaacctccggagccaaaacctctgccgtgttatccatggcctctgcagggatacggtgtaccttcctcctttcctcatcaaggatacggtgtgccttccacctttccccagggagacggtgtaccttcctcgtttccatacccgtgccatccggcacatccctacaatgatataggggaacccgtttacaatcacgaacccaattgcaaaatcatgtgaaatgagttttacagaggaagattgatagagagagcatgatgaccaatgtttttttttattgtaaagaactaaagaagcactatgtttactatttagtcatatgaataaagctctgaggccacc

SEQ ID NO: 545 - protein, 181 aa, Arabidopsis thaliana
  REGION 1..181: note = Ceres Clone ID no. 1024049
  REGION 1..181: note = Bit score of 92.8 for HMM based on sequences of Figure 1
  REGION 1..181: note = Functional Homolog Of SEQ ID NO. 483
MKQKILIRVTMTDDKTRAKAMTKAVQFKGVSAVEIKGDHRNQIEVTGVEVDMIPLIQILRKKVAFAELVSVTKVEPPKKEDEKKGGDGKGAEGKGGDQKGGDNKGPDDKEPPEPKPLPCYPWPLQGYGVPSSFPHQGYGVPSTFPQGDGVPSSFPYPCHPAHPYNDIGEPVYNHEPNCKIM

SEQ ID NO: 546 - DNA, 750 bp, Arabidopsis thaliana
  misc_feature 1..750: note = Ceres Annot ID no. 885518
  misc_feature 1..750: note = Encodes the peptide sequence at SEQ ID NO. 547
  source 1..750: mol_type = other DNA
attctaccaaacaagaaatctaagccaaaacattcaaagcgatttctcaagcaaaactagaagatgaagcaaaagatcttgataagagtgactatgaccgatgacaaaacccgagcaaaagcaatgacaaaagcagttcagtttaaaggcgtgtcagccgtggaaataaaaggcgatcacaggaaccagatagaggtaaccggcgttgaagttgatatgatccctcttatccaaatactcagaaagaaggtagcgttcgcagagcttgtgagcgtgaccaaagttgaaccaccaaagaaagaagacgagaagaaaggaggggacggaaagggtgcagagggaaaaggcggtgaccaaaaaggtggcgataagaaagggccagatgacaaggaacctccggagccaaaacctgtgccgtgttatccatggcctctgcagggatacggtgtaccttcctcctttcctcatcaaggatacggtgtgccttccacctttccccagggagacggtgtaccttcctcgtttccatacccgtgccatccggcacatccctacaatgatataggggaacccgtttacaatcacgaacccaattgcaaaatcatgtgaaatgagttttacagaggaagattgatagagagagcatgatgaccaatgtttttttttttattgtaaagaactaaagaagcactatgtttactatttagtcatatgaataaagctctgaggccaccaaatcaatttactgct

SEQ ID NO: 547 - protein, 181 aa, Arabidopsis thaliana
  REGION 1..181: note = Ceres Annot ID no. 885518
  REGION 1..181: note = Bit score of 88.5 for HMM based on sequences of Figure 1
  REGION 1..181: note = Functional Homolog Of SEQ ID NO. 483
MKQKILIRVTMTDDKTRAKAMTKAVQFKGVSAVEIKGDHRNQIEVTGVEVDMIPLIQILRKKVAFAELVSVTKVEPPKKEDEKKGGDGKGAEGKGGDQKGGDKKGPDDKEPPEPKPVPCYPWPLQGYGVPSSFPHQGYGVPSTFPQGDGVPSSFPYPCHPAHPYNDIGEPVYNHEPNCKIM

SEQ ID NO: 548 - DNA, 721 bp, Arabidopsis thaliana
  misc_feature 1..721: note = Ceres Annot ID no. 871243
  misc_feature 1..721: note = Encodes the peptide sequence at SEQ ID NO. 549
  source 1..721: mol_type = other DNA
gaagacacaaaaaagttcggagcaaactcccatcaaacaaatcacgcggattctcagaagacaataacatgaagcaaaagatcctgataagaattgctatgactgatgacacaactcgagcaaaggcaatgaaaactgcggttcagtttaaaggcgtgaacgctgtggaaataaagggagatcacaggaaccagattgaggtgaccggtgttgaagtcgatatgattgctctaatcaacacactcaggaaaaaagttgcatttgcggagcttgttagcgtagctaaagttgaaccacctaaggatggtgacaaaaagccagaagaagaaaagaaacccgaagagaagaaacccgaagagaagaaacctgaagagaagaaacctgagccatgttgtcaaccatggcaaaaacctgagccatgttatcaaccatggcctcatgatggatatggtgtgccatcttcctatccctacccgtgtgatccctacaatcagatcggggaacccgtttacaatcaagatcccaattgcaggatcatgtgagataggtttcatgtggaagattaacggaggagatagcagtttttctatactaagattgtcaacatgttaatgcaatttgatagtcagatttgttaaatgaataaaaagtcttgagctatcagtatcacacaaattctctacttgtagatgctcttataacatgtaaagccaaatcttgt

SEQ ID NO: 549 - protein, 157 aa, Arabidopsis thaliana
  REGION 1..157: note = Ceres Annot ID no. 871243
  REGION 1..157: note = Bit score of 124.3 for HMM based on sequences of Figure 1
  REGION 1..157: note = Functional Homolog Of SEQ ID NO. 483
MKQKILIRIAMTDDTTRAKAMKTAVQFKGVNAVEIKGDHRNQIEVTGVEVDMIALINTLRKKVAFAELVSVAKVEPPKDGDKKPEEEKKPEEKKPEEKKPEEKKPEPCCQPWQKPEPCYQPWPHDGYGVPSSYPYPCDPYNQIGEPVYNQDPNCRIM

SEQ ID NO: 550 - DNA, 345 bp, Populus balsamifera
  misc_feature 1..345: note = Ceres Annot ID no. 1461629
  misc_feature 1..345: note = Encodes the peptide sequence at SEQ ID NO. 551
  source 1..345: mol_type = other DNA
atgaagcaaaagatagtgatcaaggtgacggggaatggaccgaagtcacgcaccaaagccttgcggattgcagttgggctttcaggtgttgaatctgctcgtttaggaggggaagataagagccagatagaggtggtaggcgatggagttgatgcagtacaacttacaaatttgctgagaaagaaagtaggctacgcagagttagcaagtgtagaagctgtgggagaaaagaaagaagagccagaagtgcagccggttgattggcccgtgtacgttggaggcatgcctcagacctatatctatccgattcacccccatcaggacccttcttgctccatcatgtaa

SEQ ID NO: 551 - protein, 114 aa, Populus trichocarpa
  REGION 1..114: note = Ceres Annot ID no. 1461629
  REGION 1..114: note = Bit score of 223.0 for HMM based on sequences of Figure 1
  REGION 1..114: note = Functional Homolog Of SEQ ID NO. 483
MKQKIVIKVTGNGPKSRTKALRIAVGLSGVESARLGGEDKSQIEVVGDGVDAVQLTNLLRKKVGYAELASVEAVGEKKEEPEVQPVDWPVYVGGMPQTYIYPIHPHQDPSCSIM

SEQ ID NO: 552 - protein, 181 aa, Arabidopsis thaliana
  REGION 1..181: note = Public GI ID no. 27754556
  REGION 1..181: note = Bit score of 84.4 for HMM based on sequences of Figure 1
  REGION 1..181: note = Functional Homolog Of SEQ ID NO. 483
MKQKILIRVTMTDDKTRAKAITKAVQFKGVSAVEIKGDHRNQIEVTGVEVDMIPLIQILRKKVAFAELVSVTKVEPPKKEDEKKGGDGKGAEGKGGDQKGGDKKGPDDKEPPEPKPVPCYPWPLQGYGVPSSFPHQGYGVPSTFPQGDGVPSSFPYPCHPAHPYNDIGEPVYNHEPNCKIM

SEQ ID NO: 553 - DNA, 612 bp, Sorghum bicolor
  misc_feature 1..612: note = Ceres Annot ID no. 8679941
  misc_feature 1..612: note = Encodes the peptide sequence at SEQ ID NO. 554
  source 1..612: mol_type = other DNA
atggagtgcgaccggtgccggtccaaggcgctggcgctggtggcggccacgggcggggtggactccgtgtcgctcgccggcgacgccagggaccaggtcgtcgtcgtgggcgacgacgtcgactccatcaagctcgccagcgcgctgcgcaagaaggtcgggcctgcagagatcgtgcaggtcgccgccgccgaagccaagaaggaggagagcggcgccggcggcaagaatcctccggccaccacccccaccgcgctgcccgagttcgtcgcgtcgaccccgtggtactactaccagcactacccgcagccggcggccgtggtctacgagcaccccgcggccgggtatagatggccatcgggccgtgccggcccggcccttcggcacggcgtgccgtgctggcccgtgccggtgtcgtgcctcagcgggccgtcgtgccgcacgggccgtgcctccttcgtgctcgtgcctggcctacggcccaaggcacggtccgtgggccatttggccgtgccgtgccgcccgttgggcacggccaattttgccgtgccgggctggcccgtggcccgttcaagagagagggttgagcttgagcacaagtgcaaacactaa

SEQ ID NO: 554 - protein, 203 aa, Sorghum bicolor
  REGION 1..203: note = Ceres Annot ID no. 8679941
  REGION 1..203: note = Bit score of 109.2 for HMM based on sequences of Figure 1
  REGION 1..203: note = Functional Homolog Of SEQ ID NO. 483
MECDRCRSKALALVAATGGVDSVSLAGDARDQVVVVGDDVDSIKLASALRKKVGPAEIVQVAAAEAKKEESGAGGKNPPATTPTALPEFVASTPWYYYQHYPQPAAVVYEHPAAGYRWPSGRAGPALRHGVPCWPVPVSCLSGPSCRTGRASFVLVPGLRPKARSVGHLAVPCRPLGTANFAVPGWPVARSRERVELEHKCKH

SEQ ID NO: 555 - DNA, 825 bp, Gossypium hirsutum
  misc_feature 1..825: note = Ceres Clone ID no. 1846767
  misc_feature 1..825: note = Encodes the peptide sequence at SEQ ID NO. 556
  source 1..825: mol_type = other DNA
atgtcccatacaaaacacgtaacttcttcttcttccaaacatctttttgtcttcttctttcaaaaggtaacagataatcgccaccatgaaggtacgcaaacgaaccatatggattaatgtctggtaataaaaaagtttccaattttattgaaatttttcttcttcttttttcagcaaaagatggtattgaaggtttccatgaatggcgacaaatcccgctccaaggcattgaaagttgcagttggtctctcaggtaataaaaccaattccaaccatttttttaagttacactttggggaatttatgctaattgttggggttttctttctggaaggggtggagtcggcttcgttgaaaggcgatgacaagagccaaatagaggtgacaggggatggtgtggatgcagttaagctagcaagtcagttaaggaagagcgtggggttcgccgagctggttagcgtcagtgccgccggtggcgaaaagaaggaagagaagaaagacgatcctaagccagagccaccgttctgctatgtgtcgccgccgtttaatccatcataccattattatccttcgtacgaatatgtcgacaactatggcccctcccccccttgctccatcatgtaatcacagacgcggaattttacacttcacagccgacaacaataaatgagacaaatatattacttggcttgagttcctcaaattttgtagctcataatcatgtcaaatttagagctcaaatcattgtgtttcatatgcaattctttttttgtttggttttcatttttttaaatatatatatttgaagaaagcttgtgttatagc

SEQ ID NO: 556 - protein, 147 aa, Gossypium hirsutum
  REGION 1..147: note = Ceres Clone ID no. 1846767
  REGION 1..147: note = Bit score of 156.1 for HMM based on sequences of Figure 1
  REGION 1..147: note = Functional Homolog Of SEQ ID NO. 483
MVLKVSMNGDKSRSKALKVAVGLSGNKTNSNHFFKLHFGEFMLIVGVFFLEGVESASLKGDDKSQIEVTGDGVDAVKLASQLRKSVGFAELVSVSAAGGEKKEEKKDDPKPEPPFCYVSPPFNPSYHYYPSYEYVDNYGPSPPCSIM

SEQ ID NO: 557 - protein, 113 aa, Populus X generosa
  REGION 1..113: note = Public GI ID no. 118489467
  REGION 1..113: note = Bit score of 117.5 for HMM based on sequences of Figure 1
  REGION 1..113: note = Functional Homolog Of SEQ ID NO. 483
MKQKIVIKVHMHCEKCRTKAKKIAATACGVTSVALEAAKDQIVVIGEEVDSVKLAKSLRKKVGHAVLMSVQEEKEKEKEKDKDEKKGALYCYPQPALPYAVVCESNPDNCTVL

SEQ ID NO: 558 - DNA, 417 bp, Populus balsamifera
  misc_feature 1..417: note = Ceres Annot ID no. 1480319
  misc_feature 1..417: note = Encodes the peptide sequence at SEQ ID NO. 559
  source 1..417: mol_type = other DNA
atgacgaagcaaaaaatagtgctcaaggtacagatgaattgcgagaaatgtaggactaaggcactcaaggttgtggcagatgcggatggtgtgagttttatgggattaaaaggtgagaagaaagaagatattgtggtggtgattggagaaggagttgatgctgccaagttagccagcagcttaatgaagaaagttgggcatactgacattgtctcagtgttgcatgaagaggaatcactagaaatgaatatcatggaaaatcttggctctaagaatttggttgcctggggaggagtgaactcttcagcattacaaggagatgacagaattgtggtgagaggagatggaattgatgcagcccatttgacatactgcttgaggagaaaagtgaggcatactgatattatcagcatctaa

SEQ ID NO: 559 - protein, 138 aa, Populus trichocarpa
  REGION 1..138: note = Ceres Annot ID no. 1480319
  REGION 1..138: note = Bit score of 103.1 for HMM based on sequences of Figure 1
  REGION 1..138: note = Functional Homolog Of SEQ ID NO. 483
MTKQKIVLKVQMNCEKCRTKALKVVADADGVSFMGLKGEKKEDIVVVIGEGVDAAKLASSLMKKVGHTDIVSVLHEEESLEMNIMENLGSKNLVAWGGVNSSALQGDDRIVVRGDGIDAAHLTYCLRRKVRHTDIISI

SEQ ID NO: 560 - DNA, 401 bp, Panicum virgatum
  misc_feature 1..401: note = Ceres Clone ID no. 1767521
  misc_feature 1..401: note = Fragment of Ceres Clone ID no. 1767521 for RNAi construct
  misc_feature 1..401: note = RNAi targets lead sequence Figure 1
  misc_feature 1..401: note = Functional Homolog Of SEQ ID NO. 483
  source 1..401: mol_type = other DNA
ctgaatccagcaagccacaagaggcagctgctgcttctgcttgcctgcctggctgcatctgcaggctagcatcgatcgcacaccagagtgctcgatcagccaaccaatcaatccagcagccatccggcgtcagcctccgcgccgactggccggatccttctcagcggcggcacgccatgaccaagcaaaagatcgtgatcagggtgaacctggcgagcgagaagacccggtccaaggccatggcgctggtcgccagagcggacggggtgagctcgatgggggttaccggcgacggcagggaccagctggaggtggtcggcgacggcgtcgacaccgtcggcctcgtccagtgcctgcgcaagaagatcgggcacgccgagatcctcaaggtggaggaagtg

SEQ ID NO: 561 - DNA, 1042 bp, Panicum virgatum
  misc_feature 1..1042: note = Ceres Clone ID no. 1871180
  misc_feature 1..1042: note = Encodes the peptide sequence at SEQ ID NO. 562
  source 1..1042: mol_type = other DNA
gcattgaactcgccctcggttcgttccagcgcttgcccatcggactcaccgccgagacgaagccccacaacatccccccagaccccagccagcttctctctcagccccctccgcttgtcgcgttgcggacccggcgcacgccggcccgcccagatatagagcgaacagagccgccggccagacagacactcgaagcggttgcttggtgcggcaagggagaaggatcatcagaccccagttggtttactactagccggccatggctgccaagaaggtggtgctgaagatcgacctgcacgacaacaaggataagcagagggtgctcaaagcggtctccactctccacggtatcgactccatctccgtggacatgaaggactctaagctgacggtgatcgggctcgccgaccccgtcgacgtcgttgccaagctgcgcaaggtcggggccgcccacatcctctccgtcggcccggccaaggaggagaagaaggacgaaaagaaggacggcgacaagaaggatggcgataagaaggacggcgacaagaaggacggcgataagaaggtcgtggtgtacccgccgccgtggtacgccgggcagtacccctactacccccactacgtcgtccacagcgccgaggaggaccccaactcctgcgtcatctgctgattgccgatccccgcccggtttttgtaaattcctagttggcctgcctgcctacctcgagctccagcgtcagtgatcgccggctgggacccggaccagggccggggctgcggtggttggccgctgcgctcagctctatgcctctattccctgggttggttggcccgtccgcaggtcgttatatgatgacgatgacgatggccggagcaattacgcaggcgatccaggagtagttggtgggatttcaggttgcagcgccattgctgatcagcgagttgtgtagtgttcatagcatattgtatctgggttttgtccttgctatttgggtgttgaggcatgaaactatagacatatataaaggttaactgaacatacact

SEQ ID NO: 562 - protein, 135 aa, Panicum virgatum
  REGION 1..135: note = Ceres Clone ID no. 1871180
  REGION 6..73: note = Pfam Name: HMA Pfam Description: Heavy-metal-associated domain
  REGION 1..135: note = Bit score of 274.5 for HMM based on sequences of Figure 2
  REGION 1..135: note = Figure 2
MAAKKVVLKIDLHDNKDKQRVLKAVSTLHGIDSISVDMKDSKLTVIGLADPVDVVAKLRKVGAAHILSVGPAKEEKKDEKKDGDKKDGDKKDGDKKDGDKKVVVYPPPWYAGQYPYYPHYVVHSAEEDPNSCVIC

SEQ ID NO: 563 - DNA, 426 bp, Sorghum bicolor
  misc_feature 1..426: note = Ceres Annot ID no. 8703443
  misc_feature 1..426: note = Encodes the peptide sequence at SEQ ID NO. 564
  source 1..426: mol_type = other DNA
atggtgcagaaggtggtgctgaagctggacctgcacgacaacaaggacaagcagaaggtgctcaaggcggtctccactctccacggtatcgactccatctccgtggacatgaaggactcgaagctgacggtggtcgggctggtggatcccgtcgacgtcgtggccaagctgcgcaaggtcggcgccgccgccatcgtctcggtcggcccggccaaggaggagaagaaggacggcgacaagaaagacggcgacaagaaggatggcgacaagaaggacggcgacaagaagacgccgccgccggtcatactgtacccgcaccaccagtggtacccgtacgccgccgcgcagtaccacccccacccgtacccgccgcagtacgtcgtccacagcgccgaggaggaccccaactcctgcgtcatctgctga

SEQ ID NO: 564 - protein, 141 aa, Sorghum bicolor
  REGION 1..141: note = Ceres Annot ID no. 8703443
  REGION 5..72: note = Pfam Name: HMA Pfam Description: Heavy-metal-associated domain
  REGION 1..141: note = Bit score of 287.9 for HMM based on sequences of Figure 2
  REGION 1..141: note = Functional Homolog Of SEQ ID NO. 562
  REGION 1..141: note = Figure 2
MVQKVVLKLDLHDNKDKQKVLKAVSTLHGIDSISVDMKDSKLTVVGLVDPVDVVAKLRKVGAAAIVSVGPAKEEKKDGDKKDGDKKDGDKKDGDKKTPPPVILYPHHQWYPYAAAQYHPHPYPPQYVVHSAEEDPNSCVIC

SEQ ID NO: 565 - protein, 137 aa, Zea mays
  REGION 1..137: note = Public GI ID no. 194702514
  REGION 6..73: note = Pfam Name: HMA Pfam Description: Heavy-metal-associated domain
  REGION 1..137: note = Bit score of 282.3 for HMM based on sequences of Figure 2
  REGION 1..137: note = Functional Homolog Of SEQ ID NO. 562
  REGION 1..137: note = Figure 2
MAAKKLVLKLDLHDDKDKQKVLKAVSTLHGIDSISVDMKGSNLTVVGLADPVDVVARLRKVAAAEIVSVGPAKEDKKEGDKKEGDKKKKDDEKKQQVLWYPHPWHAAAAAQQYHPHPYPPQYAVHSAEEDPNSCAIC

SEQ ID NO: 566 - DNA, 888 bp, Triticum aestivum
  misc_feature 1..888: note = Ceres Clone ID no. 699934
  misc_feature 1..888: note = Encodes the peptide sequence at SEQ ID NO. 567
  source 1..888: mol_type = other DNA
accatttgtccgtcgccagtagccacattatccatcgccagagcccagcgagagacacagagtactacactccacacgccggcctttccatttcgctctgctctcccgcctcgtcccgtcgctgagttcccgtcggctcgtccgggaagagcagttcgccgccgttgaagcgccctccccggtcgctcgccgccatgaagaaggttgtgctcaagctggatgtgcacgacgacaggcacaaggccaaggcgctaaaggccgtctccggcctccacggcatcgaccagctgggcgtggacatcaaggaccagaagatgaccatcgtgggcaccgtcgaccccgtcgccgtcgtcggcaagctgcgcaagctcttccccgccgtgcagatcctctccgtcggcccgggcaaggaggagaagaaggacgacaagaaggacggcggcggggacaagaaggagggcgacaagaaagacggggacaagaaggacggcggcgacaagaagcagcaggaggcgaagccggccatgtccgtgtacccgccctacggctacgcgcactacggctacccgccgccgccgcccccgcgctacgtcgtccacagcgccgaggaggaccccaactcgtgcgtcatctgctgatcatcggcgccgacgcccaccccccttgtatatttcgtcgccgtcctgcctgtcttcctctgctgccggtggttggtgggcgctgcagggatcgacggcgtcgtttatacacttagatatacagtacgtatgaccgtgtaattaccggttgcatcggcagctgctgtttggcttgtttttggaacggagagatgcagtagtagcacatgcatctgctgatcagtttgtagagcgcatacacgagagtgac

SEQ ID NO: 567 - protein, 147 aa, Triticum aestivum
  REGION 1..147: note = Ceres Clone ID no. 699934
  REGION 4..72: note = Pfam Name: HMA Pfam Description: Heavy-metal-associated domain
  REGION 1..147: note = Bit score of 289.6 for HMM based on sequences of Figure 2
  REGION 1..147: note = Functional Homolog Of SEQ ID NO. 562
  REGION 1..147: note = Figure 2
MKKVVLKLDVHDDRHKAKALKAVSGLHGIDQLGVDIKDQKMTIVGTVDPVAVVGKLRKLFPAVQILSVGPGKEEKKDDKKDGGGDKKEGDKKDGDKKDGGDKKQQEAKPAMSVYPPYGYAHYGYPPPPPPRYVVHSAEEDPNSCVIC

SEQ ID NO: 568 - protein, 137 aa, Oryza sativa
  REGION 1..137: note = Public GI ID no. 32488374
  REGION 4..58: note = Pfam Name: HMA Pfam Description: Heavy-metal-associated domain
  REGION 1..137: note = Bit score of 280.0 for HMM based on sequences of Figure 2
  REGION 1..137: note = Functional Homolog Of SEQ ID NO. 562
  REGION 1..137: note = Figure 2
  source 1..137: note = Oryza sativa subsp. japonica
MAMKKLVLKLDLHDDKDKQKAIKAVSTLHGIDMISMDMKGQKLTVVGDVDPVDVVGKLRKGWPSASLLSVGPAKEEKKEEKKPEEKKDDKKPEQPKLVFYPPPPAWHAHAAPPSYSYPPPQYVVHSAEEDPNSCVIC

SEQ ID NO: 569 - DNA, 656 bp, Glycine max
  misc_feature 1..656: note = Ceres Clone ID no. 1642517
  misc_feature 1..656: note = Encodes the peptide sequence at SEQ ID NO. 570
  source 1..656: mol_type = other DNA
gttctctgacagttctttctccaaacctacctttctatcttttctttttcatcggagcattatttgataccctcttgagtcctctctgcagcaacgcatttttcctcattctcttaaacaatttaacttctcctcgtttgatctgcataaaattgcattaatataaaaatgaagaagtttgtactaaagttagatttgcatgatgacaaggataagcagaaggccttgaaaacagtttcaactctttcaggaattgatgccatagccatggatatgaaagagaagaaattaacagtgataggaacagttgatccggtaactgtggtgagcaaattgcgcaaatactggaaggcagacatagtagcagttggaccagtgaaggaacctgagaagaaggaggatcccaagaaagcagaagcaaagaaggagggagaaaagaaagaggagggaaagaaggaagaaggaaagaaagaagagaagaaggaggatgataagaagaaagagccagccccagatcctgttttggaatgggtcaaggcttatagggcatataacccctacatgaccacaaactactatgctccaagcatggaagagaatcccaatgcttgtgtcatttgttgaaggataaaacttagatgtaattttataagtat

SEQ ID NO: 570 - protein, 151 aa, Glycine max
  REGION 1..151: note = Ceres Clone ID no. 1642517
  REGION 4..71: note = Pfam Name: HMA Pfam Description: Heavy-metal-associated domain
  REGION 1..151: note = Bit score of 281.9 for HMM based on sequences of Figure 2
  REGION 1..151: note = Functional Homolog Of SEQ ID NO. 562
  REGION 1..151: note = Figure 2
MKKFVLKLDLHDDKDKQKALKTVSTLSGIDAIAMDMKEKKLTVIGTVDPVTVVSKLRKYWKADIVAVGPVKEPEKKEDPKKAEAKKEGEKKEEGKKEEGKKEEKKEDDKKKEPAPDPVLEWVKAYRAYNPYMTTNYYAPSMEENPNACVIC

SEQ ID NO: 571 - DNA, 615 bp, Musa acuminata
  misc_feature 1..615: note = Ceres Clone ID no. 1799746
  misc_feature 1..615: note = Encodes the peptide sequence at SEQ ID NO. 572
  source 1..615: mol_type = other DNA
ttttctgtgccggtagttggttacttgtcttcctgaaaagatgaagaaaattgtgttgaaagtggacttgcacgataacaaggacaagcaaaaggcgatgaaggccgtctccacgcttcaagggatcgattccatcgcgatggacatgaaggagatgaagatgacggtgatcggcgccaccgatcctatcgacgtcgtgggcaaactgcggaaatgctggcacaccgacatcgtctcgatcgggccgaaggaagagccgaagaaggaagatggcaaggaggagccgaagaaggacgacgcggagaagaagaaggaggcggagaagatgatcaaggagctggtcgatgcttacaaggcatataatcccggcatgaccacgcactactacgtccaaagcgcagaggagaatcccaatgcttgtgtgatcctgtgagtcatgtacatattggaagcaactcatgggtgccatagacatatgtaccagttaaataagcaagtcatgtggctattccaattaaagtgcactgtgtgaagaggctttggcactttactagccatcatccttgtgattttatgtagctattaatatgtcaattagcatactacttttgatgc

SEQ ID NO: 572 - protein, 130 aa, Musa acuminata
  REGION 1..130: note = Ceres Clone ID no. 1799746
  REGION 4..71: note = Pfam Name: HMA Pfam Description: Heavy-metal-associated domain
  REGION 1..130: note = Bit score of 264.3 for HMM based on sequences of Figure 2
  REGION 1..130: note = Functional Homolog Of SEQ ID NO. 562
  REGION 1..130: note = Figure 2
MKKIVLKVDLHDNKDKQKAMKAVSTLQGIDSIAMDMKEMKMTVIGATDPIDVVGKLRKCWHTDIVSIGPKEEPKKEDGKEEPKKDDAEKKKEAEKMIKELVDAYKAYNPGMTTHYYVQSAEENPNACVIL

SEQ ID NO: 573 - protein, 132 aa, Populus trichocarpa
  REGION 1..132: note = Public GI ID no. 224077486
  REGION 4..71: note = Pfam Name: HMA Pfam Description: Heavy-metal-associated domain
  REGION 1..132: note = Bit score of 267.2 for HMM based on sequences of Figure 2
  REGION 1..132: note = Functional Homolog Of SEQ ID NO. 562
  REGION 1..132: note = Figure 2
MKKAVLKLDLHDEKAKTKAMKKVSSLSGVDSISMDMKDKKLTVIGDVDPVDIVSKLRKLCNTEIITVGPAKEPEKKKEEPKKEEPKKQQDPKKKEQDAVDELVKAYKAYNPHMTTYYHVRSVEDDPNACVIS

SEQ ID NO: 574 - protein, 159 aa, Solanum tuberosum
  REGION 1..159: note = Public GI ID no. 83283997
  REGION 4..71: note = Pfam Name: HMA Pfam Description: Heavy-metal-associated domain
  REGION 1..159: note = Bit score of 289.8 for HMM based on sequences of Figure 2
  REGION 1..159: note = Functional Homolog Of SEQ ID NO. 562
  REGION 1..159: note = Figure 2
MKKVILKLEYFDEKIKQKAMKKVSGLEGVESISIDSKDKKLTITGNIDPVSLVSKLRKLCHTDIVSVGPAKEPEKKKDDGAKKDEGAKKDEGKKDDAKKGDDKKGGDDKKKEEAPPVMKAFPAPMLYHYQHPYQHYQPPVPAYYHHRSVEEDPNSCVIC

SEQ ID NO: 575 - protein, 131 aa, Bruguiera gymnorhiza
  REGION 1..131: note = Public GI ID no. 171451994
  REGION 4..71: note = Pfam Name: HMA Pfam Description: Heavy-metal-associated domain
  REGION 1..131: note = Bit score of 270.1 for HMM based on sequences of Figure 2
  REGION 1..131: note = Functional Homolog Of SEQ ID NO. 562
  REGION 1..131: note = Figure 2
MKKVILKLDPRDDKIKQKAMRTVSGLSGVDSVAMDMKEKKLTVTGDVDPVHVVSKLRKLCHTDIVSVGPAKEPEKKAESEKQPEGGKKDGKDAKKDDVSELIKAYQAYNPHMTTYYYVKSAEEDPNACVIC

SEQ ID NO: 576 - protein, 177 aa, Arabidopsis thaliana
  REGION 1..177: note = Public GI ID no. 15223416
  REGION 4..72: note = Pfam Name: HMA Pfam Description: Heavy-metal-associated domain
  REGION 1..177: note = Bit score of 319.2 for HMM based on sequences of Figure 2
  REGION 1..177: note = Functional Homolog Of SEQ ID NO. 562
  REGION 1..177: note = Figure 2
MKKIVLKLDLHDDRAKQKALKTVSTLPGIDSIAMDMKEKKLTVIGTVDPVNVVSKLRKYWPMTDIVLVGPAKEPEKEKKEEPKKEGGGEPPKKEGEAPKEEGKKEGEAPKKEEEKKEGGDKKEGEKKDQPQAQPQPVVPPPDHVLELVKAYKAYNPHLTTYYYAQSIEENPNACVIC

SEQ ID NO: 577 - DNA, 671 bp, Panicum virgatum
  misc_feature 1..671: note = Ceres Clone ID no. 1999925
  misc_feature 1..671: note = Encodes the peptide sequence at SEQ ID NO. 578
  source 1..671: mol_type = other DNA
attgaactcgcccccggttcgttccggcgcttgcccatcggactcaccgccgagacagagccccacgccatccccagacccccagcttctcactcagcgccctccgcttgtcgcgttgcggactcggcacacgccggcccgcccaggcccggatatagagcgaacagagcctctgagacaaccggccagatcgacatccaagcggttgcttggttcggcaagggagaaggatcagtccccagttggttttgtagccggccatggctgccaagaaggtggtgctgaagctggacctgcacgacaacaaggataagcagaaagtgctcaaagcggtctccactctccacggtattgactcgatctccgtggacatgaaggactctaagctgacggtgatcgggctcgtcgaccccgtcgacgtcgtggccaagctgcgcaaggtcggggccgcccacatcctctccgtcggcccggccaaggaggagaacaaggacgacaagaaggacggcgacaggaaggacggcgataagaaggccgtggtgtacccgccgccgtggtacgccgcgcagtacccctactacccccactacggcgtccgcagcgccgaggaggaccccaactcctgcgtcatctgctgatggcgacgccgacgccgatccccggcccggccg

SEQ ID NO: 578 - protein, 125 aa, Panicum virgatum
  REGION 1..125: note = Ceres Clone ID no. 1999925
  REGION 6..73: note = Pfam Name: HMA Pfam Description: Heavy-metal-associated domain
  REGION 1..125: note = Bit score of 244.7 for HMM based on sequences of Figure 2
  REGION 1..125: note = Functional Homolog Of SEQ ID NO. 562
MAAKKVVLKLDLHDNKDKQKVLKAVSTLHGIDSISVDMKDSKLTVIGLVDPVDVVAKLRKVGAAHILSVGPAKEENKDDKKDGDRKDGDKKAVVYPPPWYAAQYPYYPHYGVRSAEEDPNSCVIC

SEQ ID NO: 579 - DNA, 569 bp, Panicum virgatum
  misc_feature 1..569: note = Ceres Clone ID no. 100177220
  misc_feature 1..569: note = Encodes the peptide sequence at SEQ ID NO. 580
  source 1..569: mol_type = other DNA
cccctcctttcctttgttttcatcggctccgctccgctctgcatccgtgtcttgcagaattgcaagctggaagagaatttcatctgtttgtataacccacgcatgtccgggatctgaattctgacggaccagaagctcaactctgaattcaattgctgcaggtatcgactccatctccgtggacatgaaggactctaagctgacggtgatcgggctcgccgaccccgtcgacgtcgttgccaagctgcgcaaggtcgggcccgcccacatcctctccgtcggcccggccaaggaggagaagaaggacgaaaagaagaacggcgacaagaaggacggcgataagaaggacggcgacaagaaggacggcgataagaaggtcgtggtgtacccgccgccgtggtacgccgggcagtacccctactacccccactacgtcgtccacagcgccgaggaggaccccaactcctgcgtcatctgctgattgccgatccccgcccggtttttgtaaattcctagttggcctgcctgcctacctcgagctccagcgtcagtgatcgccggctgggacc

SEQ ID NO: 580 - protein, 98 aa, Panicum virgatum
  REGION 1..98: note = Ceres Clone ID no. 100177220
  REGION 5..70: note = Pfam Name: HMA Pfam Description: Heavy-metal-associated domain
  REGION 1..98: note = Bit score of 126.0 for HMM based on sequences of Figure 2
  REGION 1..98: note = Functional Homolog Of SEQ ID NO. 562
MKDSKLTVIGLADPVDVVAKLRKVGPAHILSVGPAKEEKKDEKKNGDKKDGDKKDGDKKDGDKKVVVYPPPWYAGQYPYYPHYVVHSAEEDPNSCVIC

SEQ ID NO: 581 - DNA, 664 bp, Panicum virgatum
  misc_feature 1..664: note = Ceres Clone ID no. 1822001
  misc_feature 1..664: note = Encodes the peptide sequence at SEQ ID NO. 582
  source 1..664: mol_type = other DNA
cccgcattgaactcgccctcggttcgttccagcagcgcttgcccatcggactcactgccgagacgaagccccacgccatccccccagaccccagccagcttctctctcagccccctccgcttgtcgcgttgcggacccggcacacgccggcccgcccagatatagagcgaacagagccgccggccagacagacactcgaagcggttgcttggtgcggcaagggagaaggatcatcagtccccagttggtttactactagccggccatggctgccaagaaggtggtgctgaagatcgacctgcacgacaacaaggataagaagagggtgctcaaagcggtctccactctccacggtatcgactccttctccatggacatgaaggactctaagctgacggtgatcgggctcgccgaccccgtcgacgtcgttgccaagctgcgcaaggtcggggccgcccacatcctctccgtcggcccggccaaggaggagaagaaggacgaaaagaagaacggcgacaagaaggatggcgataagaaggacggcgacaagaaggacggcgataagaaggtcgcccaaatacattttggtatatatagcttcgacaacgatgctgcagaagccgacggtgcacgatcgagcgcacagctccgcgagacggccggc

SEQ ID NO: 582 - protein, 133 aa, Panicum virgatum
  REGION 1..133: note = Ceres Clone ID no. 1822001
  REGION 6..73: note = Pfam Name: HMA Pfam Description: Heavy-metal-associated domain
  REGION 1..133: note = Bit score of 179.2 for HMM based on sequences of Figure 2
  REGION 1..133: note = Functional Homolog Of SEQ ID NO. 562
MAAKKVVLKIDLHDNKDKKRVLKAVSTLHGIDSFSMDMKDSKLTVIGLADPVDVVAKLRKVGAAHILSVGPAKEEKKDEKKNGDKKDGDKKDGDKKDGDKKVAQIHFGIYSFDNDAAEADGARSSAQLRETAG

SEQ ID NO: 583 - DNA, 899 bp, Triticum aestivum
  misc_feature 1..899: note = Ceres Clone ID no. 570418
  misc_feature 1..899: note = Encodes the peptide sequence at SEQ ID NO. 584
  source 1..899: mol_type = other DNA
cactcccctgtctgtctccaagtccaagatcacaccgcgctttcttccttccccgtcgccgatccagacgaagcgccgcacgccggttcccttcacccccgcccgccaacgtctccggccaggttggatccatggcggaaaagaaggtcgtgctgaagctggacctgcacgacgacaagcagaagcagagggctctcaaggtcgtctccactctccacggcatcgaccagatcgccgtggacatgaaggaccagaagatgacggtggtgggcaccgtcgaccccgtggacctcgtcggcaggctgcgcagcaagctcttccccacggcgcagatgctctccgtcggcccggccaaggaggagaagaaggacggcggcgccaagaaggacgacggcaagaaggatggcgacaagaaggagccgatcccggtgtacacgccgtggtacccgccgccgccgccgctgtaccacccgcacccgtactaccacaaccacagcgccgaggaggaccccagctcctgcgtcatctgctgatcggcgcgcgccgctcccttgtacattttgtagctggccgtgtgctctgctgcctgccggtcgaccatgcctgctacggtgatcgacggcgtgcaccatacttaaggccgtttaaggattttgcgccagtgatccggctgctgtgcttgtgcatctgcttagtttataaagtgcagatatggaatttattagtgtgtagtgtagaattactactagatagaactgctggagttggattttgagtgaaagttcaccgagtgctctgctctccaatgtgataacagagtagtgaaataattagattaagtgctctgctctctggtgtggaaagaaaatagtgaagcccaataaataaattgaaggtgc

SEQ ID NO: 584 - protein, 133 aa, Triticum aestivum
  REGION 1..133: note = Ceres Clone ID no. 570418
  REGION 6..89: note = Pfam Name: HMA Pfam Description: Heavy-metal-associated domain
  REGION 1..133: note = Bit score of 226.3 for HMM based on sequences of Figure 2
  REGION 1..133: note = Functional Homolog Of SEQ ID NO. 562
MAEKKVVLKLDLHDDKQKQRALKVVSTLHGIDQIAVDMKDQKMTVVGTVDPVDLVGRLRSKLFPTAQMLSVGPAKEEKKDGGAKKDDGKKDGDKKEPIPVYTPWYPPPPPLYHPHPYYHNHSAEEDPSSCVIC

SEQ ID NO: 585 - DNA, 1054 bp, Panicum virgatum
  misc_feature 1..1054: note = Ceres Clone ID no. 1998324
  misc_feature 1..1054: note = Encodes the peptide sequence at SEQ ID NO. 586
  source 1..1054: mol_type = other DNA
cgcgtcgttgcgtgttgcggcctcgccagtcgccccgcctaactttcctctgccttctccactcctcactccaccctgctccggccctgatccactgcctgccgcgccgccgctgcattccttcccagtcctctgttcttctctgagacatgtcgaagaaaattgtggtgaagctggatttgcatgacaacaaggacaagcagaaggctctcaaggccgtctccgtgctcgtcggcatcgacgccgtctcggtggacatggcggcgcacaagatgacggtgatcggcacggtggacccggtggacgtggtgagcaagctgcgcagcaagtcctgggccgcgcacatcgactccgtcggccccgccaaggagcccgagaagaaggaggagaagaaggagggcgacggcgccaagaaggaaggcgacggcaagaaggaagagggggacggcaagaaggaaggcgacggcgccaagaaggaaggcgacggcaagaaggaagagggggacggcaagaaggaaggcgacggcgccaagaaggaaggcgagggcaagaaggagggcgacggcaagaaggaggaaggcggcgggggcgggggcgagaagaagcccgccgcggtggccccgatgccgttcccgctgcaccacctgccgccgccgtacatgaacatggtcacggcggactacatgaaccagtaccgcccgccgccgccgccgcccccggcgtaccacccgtacgcgccgccgccctactactacgtgcggaacatgagcatggaggagaaccccaactcctgcgccatctgctgaagaacaaggtacaagtaatcggaaggaaggaagccttcgatcgccggccgctttctcgcgctgcatgagaccgatcgaggtaggcgaaccaacgcacgtacgtgccccatccatgtgtacatccgtcgtcgtcgaccgtattgttattattattatgagatgagatgagatgacaagacaaacaaaaatcaaacctagttttgcgagccgaaactagcagttaatttgtatcaacctaaattttagct

SEQ ID NO: 586 - protein, 218 aa, Panicum virgatum
  REGION 1..218: note = Ceres Clone ID no. 1998324
  REGION 2..57: note = Pfam Name: HMA Pfam Description: Heavy-metal-associated domain
  REGION 1..218: note = Bit score of 190.6 for HMM based on sequences of Figure 2
  REGION 1..218: note = Functional Homolog Of SEQ ID NO. 562
MSKKIVVKLDLHDNKDKQKALKAVSVLVGIDAVSVDMAAHKMTVIGTVDPVDVVSKLRSKSWAAHIDSVGPAKEPEKKEEKKEGDGAKKEGDGKKEEGDGKKEGDGAKKEGDGKKEEGDGKKEGDGAKKEGEGKKEGDGKKEEGGGGGGEKKPAAVAPMPFPLHHLPPPYMNMVTADYMNQYRPPPPPPPAYHPYAPPPYYYVRNMSMEENPNSCAIC

SEQ ID NO: 587 - DNA, 1045 bp, Triticum aestivum
  misc_feature 1..1045: note = Ceres Clone ID no. 706252
  misc_feature 1..1045: note = Encodes the peptide sequence at SEQ ID NO. 588
  source 1..1045: mol_type = other DNA
atgtgccattgctgcagttgcgtgacacgctcgcctaactcccgcacgcaccccctccaccctccgctgcccgtggccggctgtaccgcaccattcccacacaccctcacttagctagctgctcccattattctcacctgtccccatttgatccatcttctgatcgtctacccgctcgccttctctttccctgcgagcagcccaggccggaggcatgtcggccaagaagatcgtggtgaagctggagctccatgacaacaaggacaagcagaaggccatgaaggccgtctccgtcctcgtcggcatcgatgccatatccatggacctggcgtcgcgcaagatgacggtgatcggcacggtggacccggtgcacgtggtgagcaagctgcgcaagggctgggcggcctacatcgagtccgtcggcccggccaaggagcccgagaagaaagaggagaagaaggaggaggccaagaaggagggagacggggccaagaaggaaggcggcgacggcggcgacgccaagaaggagggcgacgggaagaaggagggcgacgggaagaaggacggcgacaagaaggaggagggtgacggcaagaaggacggcgacgggaagaaggacggcgacaagaaggaggagggcgatggcaagaaggacgaccagaagaagcccgccgccgtggccccgctgccgttcccgcaccacatgccgctgccgcaccacatgccgccgccctacatgtacaacgcggactacatgatgaaccagtaccggccggcgccgccggcctacccgccgccgtacgtgccgccgcagcactactacgtgcggaacatgagcatggaggagaacccaaactcgtgcgtcatctgctaagtcaaagtcgatccctcgatcgcgcgcgtacgtcccgagaggcgaccatgcatgcatctgtgtatagtagtattttctcgaccgtttttacgagaccagcaaagtttgcaagatgaaactgtacaactagtagtctactatagcactacgtacgtacatacgtacatttgt

SEQ ID NO: 588 - protein, 219 aa, Triticum aestivum
  REGION 1..219: note = Ceres Clone ID no. 706252
  REGION 6..75: note = Pfam Name: HMA Pfam Description: Heavy-metal-associated domain
  REGION 1..219: note = Bit score of 207.0 for HMM based on sequences of Figure 2
  REGION 1..219: note = Functional Homolog Of SEQ ID NO. 562
MSAKKIVVKLELHDNKDKQKAMKAVSVLVGIDAISMDLASRKMTVIGTVDPVHVVSKLRKGWAAYIESVGPAKEPEKKEEKKEEAKKEGDGAKKEGGDGGDAKKEGDGKKEGDGKKDGDKKEEGDGKKDGDGKKDGDKKEEGDGKKDDQKKPAAVAPLPFPHHMPLPHHMPPPYMYNADYMMNQYRPAPPAYPPPYVPPQHYYVRNMSMEENPNSCVIC

SEQ ID NO: 589 - protein, 225 aa, Oryza sativa
  REGION 1..225: note = Public GI ID no. 77554837
  REGION 5..91: note = Pfam Name: HMA Pfam Description: Heavy-metal-associated domain
  REGION 1..225: note = Bit score of 183.3 for HMM based on sequences of Figure 2
  REGION 1..225: note = Functional Homolog Of SEQ ID NO. 562
  source 1..225: note = Oryza sativa subsp. japonica
MSKKIVVKLDLHDNKDKQKAMKAVSSVIGIDAISMDMASRKMTVIGTVDPVDVVSKLRKASWAAYIESVGPAKEPEKKEEKKEEAKKDAGGGGGDGKKEGGDGKKEGDGGGDKKEGEGKKEGDGGGDKKDGNGDGKKEGDAKAAKKEEGGGGGGDGGGKKPAAVAPMPMPMPLHHLPPQYFNMEYMNQYHRPPPPPPAYPYVPPPQYYYVRNMSMEENPNSCAIC

SEQ ID NO: 590 - protein, 238 aa, Oryza sativa
  REGION 1..238: note = Public GI ID no. 125536425
  REGION 5..91: note = Pfam Name: HMA Pfam Description: Heavy-metal-associated domain
  REGION 1..238: note = Bit score of 183.4 for HMM based on sequences of Figure 2
  REGION 1..238: note = Functional Homolog Of SEQ ID NO. 562
  source 1..238: note = Oryza sativa subsp. indica
MSKKIVVKLDLHDNKDKQKAMKAVSSVVGIDAISMDMASRKMTVIGTVDPVDVVSKLRKASWAAYIESVGPAKEPEKKEEKKEEAKKDAGGGGGDGKKEGGDGKKEEGGDGKKEGEGKKEGDGGGDKKEGEGKKEGDGGGGDKKDGDGDGKKEGDGKAAKKEEGGGGDGGGKKPAAVAPMPMPMPLHHLPPQYFNMEYMNQYHRPPPPPPAYPYVPPPQYYYVRNMSMEENPNSCAIC

SEQ ID NO: 591 - DNA, 516 bp, Populus balsamifera
  misc_feature 1..516: note = Ceres Annot ID no. 1447508
  misc_feature 1..516: note = Encodes the peptide sequence at SEQ ID NO. 592
  source 1..516: mol_type = other DNA
atggcttgtgttcccttttggtcctttataggaaaatccccttctttctacaggtccttgtctgtagttgaaaaagtggtgttgaaattggacctccatgatgacaaggggaaacaaaaggccatgaaagctgtttcgcgcttatcaggaattgattccatttcaatggacatgaaggagaagaaaatgacagtagttggagatattgatcctgttgatgtggtgagcaagttgagaaaaatttggcacgcagagattttgactgttggaccagctaaagaggagaagaaagacgaagggaagaaagacgaaggcaagaaagatgaaggtaagaaagacgaaggcaagaaagacgaaggcaagaaggaaggtgataaaaaggaccctaacgaacaacagatggctgatctcatggcactttgcaaaaactactacaattacaatccttacccacctcagtatcattaccgtgtcgtaagagacgaggagaatccaaatgcttgtgctatctgttaa

SEQ ID NO: 592 - protein, 171 aa, Populus trichocarpa
  REGION 1..171: note = Ceres Annot ID no. 1447508
  REGION 26..93: note = Pfam Name: HMA Pfam Description: Heavy-metal-associated domain
  REGION 1..171: note = Bit score of 233.9 for HMM based on sequences of Figure 2
  REGION 1..171: note = Functional Homolog Of SEQ ID NO. 562
MACVPFWSFIGKSPSFYRSLSVVEKVVLKLDLHDDKGKQKAMKAVSRLSGIDSISMDMKEKKMTVVGDIDPVDVVSKLRKIWHAEILTVGPAKEEKKDEGKKDEGKKDEGKKDEGKKDEGKKEGDKKDPNEQQMADLMALCKNYYNYNPYPPQYHYRVVRDEENPNACAIC

SEQ ID NO: 593 - DNA, 970 bp, Panicum virgatum
  misc_feature 1..970: note = Ceres Clone ID no. 1965618
  misc_feature 1..970: note = Encodes the peptide sequence at SEQ ID NO. 594
  source 1..970: mol_type = other DNA
atttacagcttctcctcctccccggcccccgctctccaccattgcttttctccagtcctgacacccccaacctcctcggcaccattattccgttcggccattcccatcgcccccctcgcccttccttcctgccagcaaccggccacttctgctgcgccgccccgccgtgcttgcactccaccggcgacatgtcgaagaaaatcgtggtgaagctggacctgcacgacaacaaggacaagcagaaggccatcaaggccgtctcggcgctcaccgggatcgacgagatctccgtggacatggcgtcgcacaagatgacggtgatcggcatggtggaccccgtgaacgtggtgagcaggctgcgcaaggcctcgtgggcggcgaccatcgactcggtcggcccggccaaggagcccgagaagaaggatggggaggccaagaaggacggcgagggcgagaagaaggacggcgagggggagaagaaggacggcggcgacggcaagaaggcggcggcgccgacggagcagcagatcctcgccgagctgatgaaccagtaccgcgcctactacccgcccatgcacacccactactacgcccagagcttggaggagaaccccaactcctgcgccatctgctagaaagacctcgtgccgcatgaggtaatcagctacgattacttaccgtgtctagctcatgtgtatatatccggattaccagagtaggtcaaggttcttgtgaatcatgctccatgcatgcttgcgtcgtgtaaaaggcaaaagagagagagagagagagagagagagagaatagcgcctactcgtgtggtcatggtctcatggtggatacgcagggtgtctctctgtacatagaaaagcaggtagtatgatggtaacgggatgtgtaagagctgtactgtaatgatatgtatagctacagttttggacttaatttttataaaagtgttattattgat

SEQ ID NO: 594 - protein, 148 aa, Panicum virgatum
  REGION 1..148: note = Ceres Clone ID no. 1965618
  REGION 2..54: note = Pfam Name: HMA Pfam Description: Heavy-metal-associated domain
  REGION 1..148: note = Bit score of 228.5 for HMM based on sequences of Figure 2
  REGION 1..148: note = Functional Homolog Of SEQ ID NO. 562
MSKKIVVKLDLHDNKDKQKAIKAVSALTGIDEISVDMASHKMTVIGMVDPVNVVSRLRKASWAATIDSVGPAKEPEKKDGEAKKDGEGEKKDGEGEKKDGGDGKKAAAPTEQQILAELMNQYRAYYPPMHTHYYAQSLEENPNSCAIC

SEQ ID NO: 595 - DNA, 665 bp, Glycine max
  misc_feature 1..665: note = Ceres Clone ID no. 1626139
  misc_feature 1..665: note = Encodes the peptide sequence at SEQ ID NO. 596
  source 1..665: mol_type = other DNA
atcttcatttttgaaattagaaaccatctcttcctctctcagctgtctttttaatcccccttttctcattttcccttttgcaattttcactaacagtccttctttctatcttagctctcagaaacttcaataacaatgaagaaagttgtgttgaaggtggaagtacatgaagacaaaatcaagcaaaaagctatgaaggttgtctctggcatttcaggggttgagtcagtttctgtggacatgaaagacaagaaattgaccgtaattggggacattgatccagtaaaagtagcagccaagctgaggaagctttgtcacgcagaaatagtttcagttggaccagcaaaagaggaaaagaaggaagagcctaaaaaagatgataaaaaggaagatgacaagaaaaaaaatccaccaagcgaaatcgtggcagatcaactcaagttctatcaaacccatgcctattattatcagatgaaaccacaatacaatccatattacagtgccataagtgtggaagaggatcctaatagctgtgtcattatctaaattttttattactaggttggatcaaacaaattattccaaaaaatatatattgtatttgtattatctccgtttcctctaatgatttaaattttaaattgagggatagctagctagtgtgg

SEQ ID NO: 596 - protein, 136 aa, Glycine max
  REGION 1..136: note = Ceres Clone ID no. 1626139
  REGION 4..71: note = Pfam Name: HMA Pfam Description: Heavy-metal-associated domain
  REGION 1..136: note = Bit score of 212.7 for HMM based on sequences of Figure 2
  REGION 1..136: note = Functional Homolog Of SEQ ID NO. 562
MKKVVLKVEVHEDKIKQKAMKVVSGISGVESVSVDMKDKKLTVIGDIDPVKVAAKLRKLCHAEIVSVGPAKEEKKEEPKKDDKKEDDKKKNPPSEIVADQLKFYQTHAYYYQMKPQYNPYYSAISVEEDPNSCVII

SEQ ID NO: 597 - DNA, 546 bp, Sorghum bicolor
  misc_feature 1..546: note = Ceres Annot ID no. 8640237
  misc_feature 1..546: note = Encodes the peptide sequence at SEQ ID NO. 598
  source 1..546: mol_type = other DNA
atggcaaagaaaatcgtggtgaagctgcacctgcacgacaacaaggacaagcagaaggccatgaaggctgtctccgcgctcacaggcatcgacgagatatccgtggacatggcgtcgcacaagatgacggtgatcggcatggtggatccggtgaacgtggtgagcaagctgcggaaggcgtcgtggtcggcgaccatcgactccgtcgggccagccaaggagccggagaagaaagaagcaggggagaagaaggacggcgagaagaaggacggggacggcaagaaagacggcgagggggacaagaagaaggacggcgagggggagaagaaggaaggcggcgagggggacaagaagaaggacggcgacgagaaggacaaggacggcgacggcaagaaggcggcggcgccgccgacggagcagcagatcatggcggagctgatgaaccagtaccgggcgtactactacccgtacccgcacatgacctaccccacacactactacgtgcagagcatggaggagaaccccaactcctgcaccatctgctaa

SEQ ID NO: 598 - protein, 181 aa, Sorghum bicolor
  REGION 1..181: note = Ceres Annot ID no. 8640237
  REGION 5..66: note = Pfam Name: HMA Pfam Description: Heavy-metal-associated domain
  REGION 1..181: note = Bit score of 218.8 for HMM based on sequences of Figure 2
  REGION 1..181: note = Functional Homolog Of SEQ ID NO. 562
MAKKIVVKLHLHDNKDKQKAMKAVSALTGIDEISVDMASHKMTVIGMVDPVNVVSKLRKASWSATIDSVGPAKEPEKKEAGEKKDGEKKDGDGKKDGEGDKKKDGEGEKKEGGEGDKKKDGDEKDKDGDGKKAAAPPTEQQIMAELMNQYRAYYYPYPHMTYPTHYYVQSMEENPNSCTIC

SEQ ID NO: 599 - protein, 195 aa, Oryza sativa
  REGION 1..195: note = Public GI ID no. 115450453
  REGION 5..66: note = Pfam Name: HMA Pfam Description: Heavy-metal-associated domain
  REGION 1..195: note = Bit score of 182.0 for HMM based on sequences of Figure 2
  REGION 1..195: note = Functional Homolog Of SEQ ID NO. 562
  source 1..195: note = Oryza sativa subsp. japonica
MSKKIVVKLDLHDNKDKQKAMKVVSTLAGIDAISMDMASRKMTVIGTVDPVNVVSKLRKASWPAYIESLGPAKEPEKKKEGGGDAKKDGGDGKKEGGGDGKKEGGDGKKEGDGKKGEAAAAAKKEEGGGEKKVAAVAPMPMPMHQLPPPYMFNAGYMNQYRPPPPPPPAYPYAPPQYYYARDMSMEENPNPCAIC

SEQ ID NO: 600 - DNA, 459 bp, Populus balsamifera
  misc_feature 1..459: note = Ceres Annot ID no. 1438634
  misc_feature 1..459: note = Encodes the peptide sequence at SEQ ID NO. 601
  source 1..459: mol_type = other DNA
atggcttgtgttccctttcggtcctttatgggaagatctccttctttcaacaagtccttgtctgtagttgaaaaggtggtgttgaaattggacctccatgacgacaaggggaaacaaaaggccatgaaagctgtttctggcttatcaggaattgattccattgccatggacctgaaggagaagaaattgacagtaattggagatattgatcctgttgatgtggtaagcaagttaagaaagatttggcacacagagattttggctgttggaccagctaaagaggaaggcaaaaaagatgaaggcaagaaggaaggagagaaaaagaacccaaatgaacaacagatgactgagcttatgacactttacaaagactactacaacaacaatccctacccttctcagtatggttaccgagtggtatgtgctgaggagaatccaaatgcgtgtgctatatgttaa

SEQ ID NO: 601 - protein, 143 aa, Populus trichocarpa
  REGION 1..143: note = Ceres Annot ID no. 1438634
  REGION 17..84: note = Pfam Name: HMA Pfam Description: Heavy-metal-associated domain
  REGION 1..143: note = Bit score of 209.9 for HMM based on sequences of Figure 2
  REGION 1..143: note = Functional Homolog Of SEQ ID NO. 562
MGRSPSFNKSLSVVEKVVLKLDLHDDKGKQKAMKAVSGLSGIDSIAMDLKEKKLTVIGDIDPVDVVSKLRKIWHTEILAVGPAKEEGKKDEGKKEGEKKNPNEQQMTELMTLYKDYYNNNPYPSQYGYRVVCAEENPNACAIC

SEQ ID NO: 602 - protein, 132 aa, Vitis vinifera
  REGION 1..132: note = Public GI ID no. 147787209
  REGION 6..73: note = Pfam Name: HMA Pfam Description: Heavy-metal-associated domain
  REGION 1..132: note = Bit score of 239.8 for HMM based on sequences of Figure 2
  REGION 1..132: note = Functional Homolog Of SEQ ID NO. 562
  VARIANT 97: note = X can be any amino acid
MEIKKIILKLEVFDDKAKQKAMKNVSSLPGVTSISVDMKDKKLTVIGDVDPVCIVSKLRKFCRTEILSVGPAKEPEKKKEEPKKEEPKKEEKKDAKXQLADLVKAHQAFYPQYAPHYYVRSVEEDPNACVIC

SEQ ID NO: 603 - protein, 179 aa, Oryza sativa
  REGION 1..179: note = Public GI ID no. 115483110
  REGION 5..74: note = Pfam Name: HMA Pfam Description: Heavy-metal-associated domain
  REGION 1..179: note = Bit score of 218.7 for HMM based on sequences of Figure 2
  REGION 1..179: note = Functional Homolog Of SEQ ID NO. 562
  source 1..179: note = Oryza sativa subsp. japonica
MSKKIVVKLNVHDKAEKQKAMKAVSALIGIDELSMDMASQKMTVIGMVDPVNVVSKLRKSWAATIESVGPAKEPEKKEEKKDGGGDGKKDGGGDGKKEGEAGDKKDGDAAKKDGDKDGEAKKEDGDKKPAAPTEQQLFAELMNQYYHRPAAYGYNPYMSVPPHYVVQSMEENPNSCAIC

SEQ ID NO: 604 - DNA, 772 bp, Zea mays
  misc_feature 1..772: note = Ceres Clone ID no. 263964
  misc_feature 1..772: note = Encodes the peptide sequence at SEQ ID NO. 605
  source 1..772: mol_type = other DNA
gaattcccctgcgcctctcacctccctgctcgaatccagcgctcacccgcgccgcgtcgagacatgtcgaagaaaatcgtggtgaagctggacctgcacgacaacaaggacaagcagaaggcgctgaaggccatctccgtgctcgtcggcatcgacgccgtgtcggtggacatggcggcgcacaagatgacggtgatcgggacggtggacccggtgcaggtggtgagcaagctgcgcagcaagtcgtgggcggcgcacatcgactccgtcgggccggccaaggagcccgagaagaaggaggagaagaaggacggcggcggcgagaagaaggacggcggcggtggcgagggcaagaaggaggaaggggacgggaagaaggacggcggcggcggtggcgacggcaagaaagacggcgagggcaagaaggaggacggcgacggcaagaagcaggacggcgagggcaagaaggaggatggcgatggcaagaaggacgacaagaaggacggcggcggcggcggcgcagaggagaagaagcccgccgccgcggtgcccctgcccaagaagaccgctgagaaggcggcggccaaggaggccaagtcgcccaagaaggccgccaagtcccccaagaaggcatagaggggcgggcgcctttaccgctgtgatgttgaatgctcgtgttcagtagatctttacgtctgtagtgtcgtcgttgttattggaactggttagtagatctgtgcattgtggttgaaacgtgattccctgatttcac

SEQ ID NO: 605 - protein, 190 aa, Zea mays
  REGION 1..190: note = Ceres Clone ID no. 263964
  REGION 2..57: note = Pfam Name: HMA Pfam Description: Heavy-metal-associated domain
  REGION 1..190: note = Bit score of 133.3 for HMM based on sequences of Figure 2
  REGION 1..190: note = Functional Homolog Of SEQ ID NO. 562
MSKKIVVKLDLHDNKDKQKALKAISVLVGIDAVSVDMAAHKMTVIGTVDPVQVVSKLRSKSWAAHIDSVGPAKEPEKKEEKKDGGGEKKDGGGGEGKKEEGDGKKDGGGGGDGKKDGEGKKEDGDGKKQDGEGKKEDGDGKKDDKKDGGGGGAEEKKPAAAVPLPKKTAEKAAAKEAKSPKKAAKSPKKA

SEQ ID NO: 606 - DNA, 516 bp, Populus balsamifera
  misc_feature 1..516: note = Ceres Annot ID no. 1449592
  misc_feature 1..516: note = Encodes the peptide sequence at SEQ ID NO. 607
  source 1..516: mol_type = other DNA
atgattgtaaacgaagtcgttttcaacgcgggaaacaccgaagtgccttccttcagtggtcctacaatcttgcctttactaaccataaaaacaccactgagaaccctttcacctcatcaccaaaaagctgtgttgaaattggatttgcatgacgagaaagccaagacaaaagccatgaagaaagtctctagtctttcaggggtggattcaatatccatggacatgaaggacaagaagttgacagtgattggggacgttgatccagtagacatagtgagcaaactgagaaagctatgtaacacagaaataattacagtaggaccagcaaaagagccagagaagaagaaggaagaacccaagaaagaagagccaaagaagcaacaagatccgaagaagaaagaacaagatgctgtggacgagctggtcaaggcttacaaggcctataatcctcatatgactacatattatcatgttagaagtgttgaggatgatccaaatgcctgtgtaatttcttaa

SEQ ID NO: 607 - protein, 171 aa, Populus trichocarpa
  REGION 1..171: note = Ceres Annot ID no. 1449592
  REGION 43..110: note = Pfam Name: HMA Pfam Description: Heavy-metal-associated domain
  REGION 1..171: note = Bit score of 260.2 for HMM based on sequences of Figure 2
  REGION 1..171: note = Functional Homolog Of SEQ ID NO. 562
MIVNEVVFNAGNTEVPSFSGPTILPLLTIKTPLRTLSPHHQKAVLKLDLHDEKAKTKAMKKVSSLSGVDSISMDMKDKKLTVIGDVDPVDIVSKLRKLCNTEIITVGPAKEPEKKKEEPKKEEPKKQQDPKKKEQDAVDELVKAYKAYNPHMTTYYHVRSVEDDPNACVIS

SEQ ID NO: 608 - protein, 116 aa, Oryza sativa
  REGION 1..116: note = Public GI ID no. 115461178
  REGION 25..58: note = Pfam Name: HMA Pfam Description: Heavy-metal-associated domain
  REGION 1..116: note = Bit score of 164.7 for HMM based on sequences of Figure 2
  REGION 1..116: note = Functional Homolog Of SEQ ID NO. 562
  source 1..116: note = Oryza sativa subsp. japonica
SDSNYVTAGIDMISMDMKGQKLTVVGDVDPVDVVGKLRKGWPSASLLSVGPAKEEKKEEKKPEEKKDDKKPEQPKLVFYPPPPAWHAHAAPPSYSYPPPQYVVHSAEEDPNSCVIC

SEQ ID NO: 609 - protein, 132 aa, Populus tremuloides
  REGION 1..132: note = Public GI ID no. 29124977
  REGION 4..71: note = Pfam Name: HMA Pfam Description: Heavy-metal-associated domain
  REGION 1..132: note = Bit score of 263.9 for HMM based on sequences of Figure 2
  REGION 1..132: note = Functional Homolog Of SEQ ID NO. 562
MKKAVLKLDLHDEKAKTKAMKKVSSLSGVDSISMDMKDKKLTVIGDVDPVHIVSKLRKLCNTEIITVGPAKEPEKKKEEPKKEEPKKQEDPKKKEQDAVAELVKAYKAYNPPMTTYYHVRSVEDDPNACVIS

SEQ ID NO: 610 - DNA, 647 bp, Glycine max
  misc_feature 1..647: note = Ceres Clone ID no. 476087
  misc_feature 1..647: note = Encodes the peptide sequence at SEQ ID NO. 611
  source 1..647: mol_type = other DNA
gttcaactagaacaatctcttaaccctctctcaaactccttcagaatccccctttcccagttcccaacttcatttcaaatcaatatgaagaaaattgtgctaaagttggaaatccatgacgacaaaaccaagaaaaaggccatgagggcagtatctggtatttcaggggtggagacagtctcagtggacatgaatgacctgaaaatgactataattgggaatgttgatgctgtaatagtagttggcaagcttagaaaatgttgtgatcatgctgatatactatcagttggaccagccaaagaggagaagaaagaggaaccaaagaaagatgagaagaagccagaagacaagaaagatccaaaggaggaatatgctgaacttctgaacgccttttataatcagaccagacagcagcaataccccccttattatcacagaacagtggaagaggatccaactagctgtgttatttgctaagtattggaatatcatatggagtttgaaatgatggataataaaatgagatcaagaaaagatggtggctgcatggagttgaagaagaattatgtttyttttggagttccctttttccttcttttctttcttatgttttggtctttcaggctttcctcttgttttagttcatg

SEQ ID NO: 611 - protein, 130 aa, Glycine max
  REGION 1..130: note = Ceres Clone ID no. 476087
  REGION 4..72: note = Pfam Name: HMA Pfam Description: Heavy-metal-associated domain
  REGION 1..130: note = Bit score of 189.8 for HMM based on sequences of Figure 2
  REGION 1..130: note = Functional Homolog Of SEQ ID NO. 562
MKKIVLKLEIHDDKTKKKAMRAVSGISGVETVSVDMNDLKMTIIGNVDAVIVVGKLRKCCDHADILSVGPAKEEKKEEPKKDEKKPEDKKDPKEEYAELLNAFYNQTRQQQYPPYYHRTVEEDPTSCVIC

SEQ ID NO: 612 - DNA, 666 bp, Zea mays
  misc_feature 1..666: note = Ceres Clone ID no. 1587840
  misc_feature 1..666: note = Encodes the peptide sequence at SEQ ID NO. 613
  source 1..666: mol_type = other DNA
gccatcgttccctcctctgcacccccatcctcggacctcctcgtctgcagcagaccctcctctggtgcgcgtgcgccgccggcgagatgtcgaagaaaatcgtggtgaagctgcacctgcaggacaacaaggacaagcagaaggccatgaaggctgtctcggcgctcaccggcatcgacgagatatccgcggacatggcgtcgcacaagatgacggtggtcggcatggtggaccccgtgagcgtggtgagcaagctgcgcaaggcgtcgtggtcggcgaccatcgagtccgtcggcccggccaaggagtcggagaagaaggacggggaggcggccaagaaggaaggcggcgagggcgagaagaagaaatgcggcgagggggagaagaaggaagcaggcgagggggagaagaaagaagcgggcggcgagaaggacaaggacgacaagaaggcggcgccgccgacgccgacgccgacggagcagcaggtccagctggccgagctgttgaaccagtattaccgggccctctcctactacccgtacccgcccgtgggcacgcactaccacgtccagagcatggaggaggacccccactcctgcaccgtctgctaaggcgactcatggcatggagaatgatctaccaaagtgaagaagggggtgttgaacc

SEQ ID NO: 613 - protein, 174 aa, Zea mays
  REGION 1..174: note = Ceres Clone ID no. 1587840
  REGION 13..54: note = Pfam Name: HMA Pfam Description: Heavy-metal-associated domain
  REGION 1..174: note = Bit score of 192.4 for HMM based on sequences of Figure 2
  REGION 1..174: note = Functional Homolog Of SEQ ID NO. 562
MSKKIVVKLHLQDNKDKQKAMKAVSALTGIDEISADMASHKMTVVGMVDPVSVVSKLRKASWSATIESVGPAKESEKKDGEAAKKEGGEGEKKKCGEGEKKEAGEGEKKEAGGEKDKDDKKAAPPTPTPTEQQVQLAELLNQYYRALSYYPYPPVGTHYHVQSMEEDPHSCTVC

SEQ ID NO: 614 - DNA, 721 bp, Gossypium hirsutum
  misc_feature 1..721: note = Ceres Clone ID no. 1808797
  misc_feature 1..721: note = Encodes the peptide sequence at SEQ ID NO. 615
  source 1..721: mol_type = other DNA
gtcaaacccaaagcttctcctacacgtctactttcctctctcttttttccccctctatttctctttcaatctttgttacacaaattatctccaaagcttgaaaatgaagaaagtggtgctgaaattggattttcacgacaacaaatgcagacagaaagccatgaaaacagcctctggtctttcaggggttgaatcagttgccctggacaaggaccaaaaactcacactcacgggagacgttgatccagtcgtggcagtaaggaaactaaggaaggtatgttacactgaaatagtctcggtcggaccggcgaaagagccggagaagaagaaagatgagcccaagaaagacgaaccgaaaaaaccggcggatacgagcaaagatccgcccaaaggcgcggtggtacagtacgtttatcacccctcaatgccccagtactacccgccggtacccgattattacagttacggtaaaagtgtggaggaagatccggctggttgtgttatctgctaaaatttttgttctttatatatacatatattagttggaaaactcaatgaagaagaagatgaaaaaaaataaaacacattttggattggtttttttctttttaaattctgtttttgtacagcatggtggattgattttagttttgttctcacatatgttgtattctatttttattagtaatggaaaattaaaattattaattttcagtatttc

SEQ ID NO: 615 - protein, 135 aa, Gossypium hirsutum
  REGION 1..135: note = Ceres Clone ID no. 1808797
  REGION 4..70: note = Pfam Name: HMA Pfam Description: Heavy-metal-associated domain
  REGION 1..135: note = Bit score of 179.9 for HMM based on sequences of Figure 2
  REGION 1..135: note = Functional Homolog Of SEQ ID NO. 562
MKKVVLKLDFHDNKCRQKAMKTASGLSGVESVALDKDQKLTLTGDVDPVVAVRKLRKVCYTEIVSVGPAKEPEKKKDEPKKDEPKKPADTSKDPPKGAVVQYVYHPSMPQYYPPVPDYYSYGKSVEEDPAGCVIC

SEQ ID NO: 616 - DNA, 604 bp, Glycine max
  misc_feature 1..604: note = Ceres Clone ID no. 538771
  misc_feature 1..604: note = Encodes the peptide sequence at SEQ ID NO. 617
  source 1..604: mol_type = other DNA
agttcaattagaacaatctcttaaccctatctcaaattcattcagattctcccttcccctttttgatttttcttagaaaactcccaacttcgaatcaatatgaagaaagtggtgctaaaggtggaactccatgatgacaaaatcaagaaaaaggccatgaaggcagtatctggtatttcaggggtagagtcagtctcagtggacatgaaggaccagaaaatgactataattggggatgttgatcctgtaacagtagttggaaagtttacaaaattcagtcttggcaagcttagaaaattctgtcatgttgagatactttcagttggaccagccaaagaggaaccaaagaaagaggagaagaagccagaagccaagaaagatccaaaggaggaatatgctgaacttctgaaggtagttgaagccaattattatcagactagacatctgcaatacccttattactatagcagaactgtggaagagaatccaactggctgtgttatttgctaagtattggagtttgatggataataaatgagatcaaggaaagaagatggtggctggagttgagaaagatttgtttctgtttttgaaatttcctttt

SEQ ID NO: 617 - protein, 136 aa, Glycine max
  REGION 1..136: note = Ceres Clone ID no. 538771
  REGION 4..79: note = Pfam Name: HMA Pfam Description: Heavy-metal-associated domain
  REGION 1..136: note = Bit score of 178.0 for HMM based on sequences of Figure 2
  REGION 1..136: note = Functional Homolog Of SEQ ID NO. 562
MKKVVLKVELHDDKIKKKAMKAVSGISGVESVSVDMKDQKMTIIGDVDPVTVVGKFTKFSLGKLRKFCHVEILSVGPAKEEPKKEEKKPEAKKDPKEEYAELLKVVEANYYQTRHLQYPYYYSRTVEENPTGCVIC

SEQ ID NO: 618 - DNA, 733 bp, Gossypium hirsutum
  misc_feature 1..733: note = Ceres Clone ID no. 1851138
  misc_feature 1..733: note = Encodes the peptide sequence at SEQ ID NO. 619
  source 1..733: mol_type = other DNA
gtcaaacccaaagcttctcctacacttctactttcctctctcttttttttccccctctattatttctctttcaatttctgttacacaaattatccccaaagcttgaaaatgaagaaagtggtgctgaaattggattttcacgacaacaaaggcagacaaaaagccatgaaaacagcctctggtctttcaggggttgaatcagttgccctggacaaggaccaaaaactcacactcacgggagacgttgatccagtcgtggcagtaaggaaactaaggaaggtatgttacactgaaatagtctcggtcggaccggcgaaagagccggagaagaagaaagaagagcccaagaaagatgaaccgaaaaaaccggcggatacgagcaaagatccgcccaaaggcgcggtggtacagtacgtttatcacccctcaatgccccaatactatccgccggtacccgattattacagttacggtaaaagtgtggaggaagatccggctggttgtgttatctgctaaaatttttgttctttgtatatgcatatattagttggaaaactcaatgaagaagaagatgaaaaacaaaaataaaaataaaacacattatggattggttatttttcttttttaaattctgtttttgtacagcatggtggattgattttagtttttgttttcacatatgttgtattctatttttattagtaatggaaaattaaaatcattacttttgcgt

SEQ ID NO: 619 - protein, 135 aa, Gossypium hirsutum
  REGION 1..135: note = Ceres Clone ID no. 1851138
  REGION 4..70: note = Pfam Name: HMA Pfam Description: Heavy-metal-associated domain
  REGION 1..135: note = Bit score of 180.4 for HMM based on sequences of Figure 2
  REGION 1..135: note = Functional Homolog Of SEQ ID NO. 562
MKKVVLKLDFHDNKGRQKAMKTASGLSGVESVALDKDQKLTLTGDVDPVVAVRKLRKVCYTEIVSVGPAKEPEKKKEEPKKDEPKKPADTSKDPPKGAVVQYVYHPSMPQYYPPVPDYYSYGKSVEEDPAGCVIC

SEQ ID NO: 620 - DNA, 480 bp, Glycine max
  misc_feature 1..480: note = Ceres Clone ID no. 1049645
  misc_feature 1..480: note = Encodes the peptide sequence at SEQ ID NO. 621
  source 1..480: mol_type = other DNA
aacatagagagcattattcgatttcgtattgcactctctcatctcatctcccattctcattctagctaacatccccttttcttcttctcacttctctccaagttttttcttcacatttctctgcctttgatctgcacacacaacaacatccctctaaaaaacatagagggataaaataaaaacatgaagaaatttgtactcaagttagatttgccagatgacaaggcaaagcagaaggccctgaaaacagtttcaacacttycagggattgatgccatctctatggacatgaaggagaagaaattaacagtgataggaacagttgatccagtgaatgttgtgagcaaactccgcaagtattggcagacagacatactctcagtaggtccagcaaaggagcccgagaagaaagaggagccaaagaaagaagagaagaaagaggagccaaagaaagagggtgaagccaaaaaggaagaggag

SEQ ID NO: 621 - protein, 99 aa, Glycine max
  REGION 1..99: note = Ceres Clone ID no. 1049645
  REGION 4..71: note = Pfam Name: HMA Pfam Description: Heavy-metal-associated domain
  REGION 1..99: note = Bit score of 136.9 for HMM based on sequences of Figure 2
  REGION 1..99: note = Functional Homolog Of SEQ ID NO. 562
  VARIANT 27: note = X can be any amino acid
MKKFVLKLDLPDDKAKQKALKTVSTLXGIDAISMDMKEKKLTVIGTVDPVNVVSKLRKYWQTDILSVGPAKEPEKKEEPKKEEKKEEPKKEGEAKKEEE

SEQ ID NO: 622 - protein, 127 aa, Medicago truncatula
  REGION 1..127: note = Public GI ID no. 92897781
  REGION 5..71: note = Pfam Name: HMA Pfam Description: Heavy-metal-associated domain
  REGION 1..127: note = Bit score of 172.2 for HMM based on sequences of Figure 2
  REGION 1..127: note = Functional Homolog Of SEQ ID NO. 562
MNKLVLKVDLYDDRIKQKAMKMVSGLSGVEGVSMNMKDKKITLIGDMDPVRVVSKLRKLCHAEIIMIGPAKEEKEEEKKEEPKKKVTKEELDDLVKAYETYYNEMKQPYPYQYYRSVEESPSGCVIC

SEQ ID NO: 623 - DNA, 378 bp, Populus balsamifera
  misc_feature 1..378: note = Ceres Annot ID no. 1487378
  misc_feature 1..378: note = Encodes the peptide sequence at SEQ ID NO. 624
  source 1..378: mol_type = other DNA
atggaaattaagaaagctgtgttgaaattggagttgcatgataagaaagccaagaaaaaagccatgacgatagtctctggtctttcaggggtggattcagtatccatcgacatgaaggacaagaagatgacagtgataggggacattgatccagtatgcatagtggccaaactgagaaagctgtgtggcacagaaatagtcacagtaggaccggcaaaagagcctgagaagaaaaaagatgagccgccgaagaagccagaaggagatcagaagaaagatcccgagcctgtggcttacctggcctatcatcctcatatgcccccatattgttatgtttcatgtgtagaggataatcaaaatgcttgtgtcatttcttaa

SEQ ID NO: 624 - protein, 125 aa, Populus trichocarpa
  REGION 1..125: note = Ceres Annot ID no. 1487378
  REGION 6..73: note = Pfam Name: HMA Pfam Description: Heavy-metal-associated domain
  REGION 1..125: note = Bit score of 191.7 for HMM based on sequences of Figure 2
  REGION 1..125: note = Functional Homolog Of SEQ ID NO. 562
MEIKKAVLKLELHDKKAKKKAMTIVSGLSGVDSVSIDMKDKKMTVIGDIDPVCIVAKLRKLCGTEIVTVGPAKEPEKKKDEPPKKPEGDQKKDPEPVAYLAYHPHMPPYCYVSCVEDNQNACVIS

SEQ ID NO: 625 - protein, 109 aa, Medicago truncatula
  REGION 1..109: note = Public GI ID no. 92897782
  REGION 5..71: note = Pfam Name: HMA Pfam Description: Heavy-metal-associated domain
  REGION 1..109: note = Bit score of 124.1 for HMM based on sequences of Figure 2
  REGION 1..109: note = Functional Homolog Of SEQ ID NO. 562
MNKLVLKVDLYDDRIKQKAMKAVSGLSGLDAVSIDMKDKKMTLIGDMDPVSVVSKLRKLCHAEIIMIGPAKEEKEEEKEEEEKKEEENKEEELDDLVTAYETIISLSVL

SEQ ID NO: 626 - DNA, 668 bp, Glycine max
  misc_feature 1..668: note = Ceres Clone ID no. 648917
  misc_feature 1..668: note = Encodes the peptide sequence at SEQ ID NO. 627
  source 1..668: mol_type = other DNA
aactagttcaaaacagtgagctccttcacttggactcttgtttggctttcctagcaaccttcgtgtcaatgaataaagttgtgctacatgtggaactacacgatggcaaaattaagaaaaaagccatgaaggtagtatccaatctttcaggggttgaatcagtctcaatggatatgaaagaccagaaattgaccttaattggagatatcgaccctgtggttgcagtggagaagctgaggaagctgtgtgacactcgcatagtctctgttggaccagccaaggaagagaatgagggaaagaataatgaagtggaggcagcagagaatcaaaatcagaataacttggctgatagtgtgaatatctacgaagcctaccacatacataatcagtatcagatgaggcaacatcattattgttgcactagtgtggaagagaatcctaatgatgcctgtgtcatttgctaactgctaagttcattttacaacatcatggaactcaaaaacaaaataagaactctagaaaagtgcttgcatggttgttccaagttgtactggtgcatttcatccatctcagctttcctttctccctagctaccacttattttgttattatatatatatagtctcactttattaatcaattttaatattagaaacgtctttaaactg

SEQ ID NO: 627 - protein, 131 aa, Glycine max
  REGION 1..131: note = Ceres Clone ID no. 648917
  REGION 5..71: note = Pfam Name: HMA Pfam Description: Heavy-metal-associated domain
  REGION 1..131: note = Bit score of 159.3 for HMM based on sequences of Figure 2
  REGION 1..131: note = Functional Homolog Of SEQ ID NO. 562
MNKVVLHVELHDGKIKKKAMKVVSNLSGVESVSMDMKDQKLTLIGDIDPVVAVEKLRKLCDTRIVSVGPAKEENEGKNNEVEAAENQNQNNLADSVNIYEAYHIHNQYQMRQHHYCCTSVEENPNDACVIC

SEQ ID NO: 628 - DNA, 535 bp, Gossypium hirsutum
  misc_feature 1..535: note = Ceres Clone ID no. 100011205
  misc_feature 1..535: note = Encodes the peptide sequence at SEQ ID NO. 629
  source 1..535: mol_type = other DNA
ctcctacacgtctactttcctctctcttttttccccctctatttctctttcaatctttgttacacaaattatctccaaagcttgaaaatgaaggttagatttccatttctttaatttgtattcttacataatatatatatgtttactgaaactggttctgttttcttacagaaagtggtgctgaaattggattttcacgacaacaaatgcagacagaaagccatgaaaacagcctctggtctttcaggggttgaatcagttgccctggacaaggaccaaaaactcacactcacgggagacgttgatccagtcgtggcagtaaggaaactaaggaaggtatgttacactgaaatagtctcggtcggaccggcgaaagagccggagaagaagaaagatgagcccaagaaagacgaaccgaaaaaaccggcggatacgagcaaagatccgcccaaaggcgcggtggtacagtacgtttatcacccctcaatgccccagtactacccgccggtacccgattattacagttacggtaaaa

SEQ ID NO: 629 - protein, 132 aa, Gossypium hirsutum
  REGION 1..132: note = Ceres Clone ID no. 100011205
  REGION 13..79: note = Pfam Name: HMA Pfam Description: Heavy-metal-associated domain
  REGION 1..132: note = Bit score of 122.6 for HMM based on sequences of Figure 2
  REGION 1..132: note = Functional Homolog Of SEQ ID NO. 562
MFTETGSVFLQKVVLKLDFHDNKCRQKAMKTASGLSGVESVALDKDQKLTLTGDVDPVVAVRKLRKVCYTEIVSVGPAKEPEKKKDEPKKDEPKKPADTSKDPPKGAVVQYVYHPSMPQYYPPVPDYYSYGK

SEQ ID NO: 630 - protein, 138 aa, Picea sitchensis
  REGION 1..138: note = Public GI ID no. 116783342
  REGION 4..64: note = Pfam Name: HMA Pfam Description: Heavy-metal-associated domain
  REGION 1..138: note = Bit score of 139.6 for HMM based on sequences of Figure 2
  REGION 1..138: note = Functional Homolog Of SEQ ID NO. 562
MKKIVLKSTMEDERSKRRAMKAVAGIGVDSIAVDIKEEKITVVGEVDPVWLTTKLRKMGFRAELLSVGPAKEEKKSDQGPPKNEKKDAEKKKDEKKAVEPAAAPTVVHYLNPDVYVPYSQGYSYTVVPEEYPSTCTIS

SEQ ID NO: 631 - DNA, 384 bp, Populus balsamifera
  misc_feature 1..384: note = Ceres Annot ID no. 1449591
  misc_feature 1..384: note = Encodes the peptide sequence at SEQ ID NO. 632
  source 1..384: mol_type = other DNA
atgcagaaagctatgttgaaactggatatgcatgatgagaaaaccaagaaaaaggctatgaagacagtctctggtttctcaggggtggattcaatatccatggactggaacgacaagaaattgacagtaacaggcgacatcgacccagtaaacatagtgaaaaaattgagaaagttttgtcacgtagagatagtttctgtaggagaagcaaaagaacctgaaaagaaaaaagaagagccagagaaacaagaagatgagaagaaagatgttcatcaaaacgtggatgagatggcgagggcttacagggcctattatcctcacgcgaccatgtattaccatgtttcaagtgttgaggatggtactaatgcttgtgtcatttcttaa

SEQ ID NO: 632 - protein, 127 aa, Populus trichocarpa
  REGION 1..127: note = Ceres Annot ID no. 1449591
  REGION 4..71: note = Pfam Name: HMA Pfam Description: Heavy-metal-associated domain
  REGION 1..127: note = Bit score of 196.7 for HMM based on sequences of Figure 2
  REGION 1..127: note = Functional Homolog Of SEQ ID NO. 562
MQKAMLKLDMHDEKTKKKAMKTVSGFSGVDSISMDWNDKKLTVTGDIDPVNIVKKLRKFCHVEIVSVGEAKEPEKKKEEPEKQEDEKKDVHQNVDEMARAYRAYYPHATMYYHVSSVEDGTNACVIS

SEQ ID NO: 633 - DNA, 536 bp, Glycine max
  misc_feature 1..536: note = Ceres Clone ID no. 521942
  misc_feature 1..536: note = Encodes the peptide sequence at SEQ ID NO. 634
  source 1..536: mol_type = other DNA
gatcacaacttcatttccaaaataaaaagacttccttttttgcaattgtcatttgtcaccaaacaattgttgttagctctcacaagcaagcttcagcaacgacaatgaagaaagtagtcttacagttggacttacatggtgatagaatcaagcaaaaagctatgaaaacagcatctggcctttcaggggttgaatcagtttctgttgatatgaaagacatgaaaatgatcgtgttgggggacattgatccagtgagtgcagtgtccaagctacgaaagtgttgtcacactgaaatagtttcagttggaccagcaaaagaggagaagaaggagaatgtggagccagcaaaagtacctgttcctctaaagctccatgaagcctatcccctttattatcagatgacaccacattatagtcaaagtcactatgccacaagttacgaagaggatcctagtggctgtgtcatctgctaaatttcagaatgttggaaagtttgataaataaataaaagaccaagtagtcattttgttgctttt

SEQ ID NO: 634 - protein, 122 aa, Glycine max
  REGION 1..122: note = Ceres Clone ID no. 521942
  REGION 4..71: note = Pfam Name: HMA Pfam Description: Heavy-metal-associated domain
  REGION 1..122: note = Bit score of 166.8 for HMM based on sequences of Figure 2
  REGION 1..122: note = Functional Homolog Of SEQ ID NO. 562
MKKVVLQLDLHGDRIKQKAMKTASGLSGVESVSVDMKDMKMIVLGDIDPVSAVSKLRKCCHTEIVSVGPAKEEKKENVEPAKVPVPLKLHEAYPLYYQMTPHYSQSHYATSYEEDPSGCVIC

SEQ ID NO: 635 - DNA, 688 bp, Glycine max
  misc_feature 1..688: note = Ceres Clone ID no. 1653508
  misc_feature 1..688: note = Encodes the peptide sequence at SEQ ID NO. 636
  source 1..688: mol_type = other DNA
atcacaatttcatttccaaaataaaagtcatagttacctcttcgccttcctttgcaattgtcatttgtcgccaaacaattattgcttagctctcacaagcaagctttaacaacaatgaagaaagtagtgttaaagttggacttacatggtgatagaatcaagcaaaaagctatgaagacagcatctggcctttcaggggttgaatcagtttctgttgacatgaaagacatgaaaatgatcgtgttgggggatattgatccagtgagtgcagtgtccaaactacgaaagtgttgtcacactgaactagtttcagttggacaagcagaagagaataagaaggagaatgtggagccagcaaaagtacctgttcctctaaagctccatgaaccttatcccctttattatcatatgacatcacagtatactcaaagttactatgtctcaagttacgaagagaatcccagaggctgtgtcatctgctaaatttcataatattagaaagtttgattttatgacaaagtagtcattttttgttacttttatttgtattatgcatgatctagtagattgaagattatggtgtgtccaagagactaaatatgctgtacatagtgggtgtatgacacgactttgtcattctgtacaatgtagacaaaaatttgatccgttagtcataagcattactacc

SEQ ID NO: 636 - protein, 122 aa, Glycine max
  REGION 1..122: note = Ceres Clone ID no. 1653508
  REGION 4..71: note = Pfam Name: HMA Pfam Description: Heavy-metal-associated domain
  REGION 1..122: note = Bit score of 156.6 for HMM based on sequences of Figure 2
  REGION 1..122: note = Functional Homolog Of SEQ ID NO. 562
MKKVVLKLDLHGDRIKQKAMKTASGLSGVESVSVDMKDMKMIVLGDIDPVSAVSKLRKCCHTELVSVGQAEENKKENVEPAKVPVPLKLHEPYPLYYHMTSQYTQSYYVSSYEENPRGCVIC

SEQ ID NO: 637 - DNA, 345 bp, Populus balsamifera
  misc_feature 1..345: note = Ceres Annot ID no. 1487377
  misc_feature 1..345: note = Encodes the peptide sequence at SEQ ID NO. 638
  source 1..345: mol_type = other DNA
atgaagaaagctgtgctgagattggatctgcatgaagagaaagctaagaagaaagccatgaagacagtctctaggcttccaggggtgcattcaatatccatggagatgaaggaccagaagctgacagtgatagggaacattgatccagtacacatagttgccaaactgagaaagctgtgttgcacagaaatagttacagtagaaccggcaaaagaacctgaaaagaagaaggaagagccgaagaagcaagatcaagatcttcacatcactgcttatcattaccattatccacatgttgaatatactcgaatctcatcaatattaaactatgatttcaatatttaa

SEQ ID NO: 638 - protein, 114 aa, Populus trichocarpa
  REGION 1..114: note = Ceres Annot ID no. 1487377
  REGION 4..71: note = Pfam Name: HMA Pfam Description: Heavy-metal-associated domain
  REGION 1..114: note = Bit score of 120.4 for HMM based on sequences of Figure 2
  REGION 1..114: note = Functional Homolog Of SEQ ID NO. 562
MKKAVLRLDLHEEKAKKKAMKTVSRLPGVHSISMEMKDQKLTVIGNIDPVHIVAKLRKLCCTEIVTVEPAKEPEKKKEEPKKQDQDLHITAYHYHYPHVEYTRISSILNYDFNI

SEQ ID NO: 639 - DNA, 493 bp, Panicum virgatum
  misc_feature 1..493: note = Ceres Clone ID no. 1871180
  misc_feature 1..493: note = Fragment of Ceres Clone ID no. 1871180 for RNAi construct
  misc_feature 1..493: note = RNAi targets lead sequence Figure 2
  misc_feature 1..493: note = Functional Homolog Of SEQ ID NO. 562
  source 1..493: mol_type = other DNA
attgaactcgccctcggttcgttccagcgcttgcccatcggactcaccgccgagacgaagccccacaacatccccccagaccccagccagcttctctctcagccccctccgcttgtcgcgttgcggacccggcgcacgccggcccgcccagatatagagcgaacagagccgccggccagacagacactcgaagcggttgcttggtgcggcaagggagaaggatcatcagaccccagttggtttactactagccggccatggctgccaagaaggtggtgctgaagatcgacctgcacgacaacaaggataagcagagggtgctcaaagcggtctccactctccacggtatcgactccatctccgtggacatgaaggactctaagctgacggtgatcgggctcgccgaccccgtcgacgtcgttgccaagctgcgcaaggtcggggccgcccacatcctctccgtcggcccggccaaggaggagaagaaggacga

SEQ ID NO: 640 - DNA, 1180 bp, Panicum virgatum
  misc_feature 1..1180: note = Ceres Clone ID no. 1955550
  misc_feature 1..1180: note = Encodes the peptide sequence at SEQ ID NO. 641
  source 1..1180: mol_type = other DNA
atcccaacaatccactcgatcagtgacaacctcctcaaccgagctcccagcacttcgcgaactctcgctagctagagctgctgctgcctgcaacgatcagctgagaagaagatgaggtcgttggcggtcgccgtcgcggcgatggcctgcctggcggcggtggcgcgggccggcaacttctaccaggacacggagatgacctggggcggcgggcgcggcaaggtcgtggacggcgggcgcgggctcgacctcacgctggaccgcacctccggctccgggttccagtccaagagcgagtacctcttcggcaagatcgacatgcagatcaagctggtccccggcaactccgccggcaccgtcaccaccttctacctctcgtcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccacggcctaccacacctactccatcgtctggaacccgcagcacatcatcttcgcggtggacggcaccccgatccgtgacttcaagaaccacgaggcgcacggcgtggcgttccccaagagccagccgatgcggctgtacgcgagcctgtggaacgccgacgactgggcgacgcagggcgggcgcgtgaaggcggactggtcccacgcgccgttcgtggcctccttccggggcttccgcgccgacgcctgcgtctggtccggcggccggcagcagtgccccgtgggcaccatggaggccgccgcccgcggctggtggagccagcagctgagcgacacgagctaccgccgcatgcgctgggtgcagaggaagttcatgatctacaactactgcaccgacgccaagcgcttcccgcagggcgtccccgccgagtgccacctccggtgagctgctagcggctgccgcagtgccgtgcacgcacgatggttcgtcgccgtcccaacccatcgcatcatggcgaagaataaggatcgtttttgcatgatggggccgggcgatgtacaatgtaaatgtagcagcagcgcgcgtatcgcattctttgatttgtttctgtaacaccagatgtacacctgtcatcaagtttctttcagcataatcttccgtc

SEQ ID NO: 641 - protein, 283 aa, Panicum virgatum
  REGION 1..283: note = Ceres Clone ID no. 1955550
  REGION 23..204: note = Pfam Name: Glyco_hydro_16 Pfam Description: Glycosyl hydrolases family 16
  REGION 228..280: note = Pfam Name: XET_C Pfam Description: Xyloglucan endo-transglycosylase (XET)
  REGION 1..283: note = Bit score of 718.1 for HMM based on sequences of Figure 11
  REGION 1..283: note = Figure 11
MRSLAVAVAAMACLAAVARAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEAHGVAFPKSQPMRLYASLWNADDWATQGGRVKADWSHAPFVASFRGFRADACVWSGGRQQCPVGTMEAAARGWWSQQLSDTSYRRMRWVQRKFMIYNYCTDAKRFPQGVPAECHLR

SEQ ID NO: 642 - DNA, 879 bp, Sorghum bicolor
  misc_feature 1..879: note = Ceres Annot ID no. 8744420
  misc_feature 1..879: note = Encodes the peptide sequence at SEQ ID NO. 643
  source 1..879: mol_type = other DNA
atgaggtcgaccgcgcttgttgcgttcgtggcggtggcgtgcctagcggccgtcgcacacggcggcaacttctacaaggacacggagatgacctgggggcaaggccgtggcaaggtggtggacggcgggcgcgggctggacctaaccctggacaggacctccggctccggcttccagtccaagtccgagtacctcttcggcaagatcgacatgcagatcaagctggtgccaggcaactcggccggcaccgtcaccaccttctacctctcctcgcaaggccccacccacgacgagatcgacttcgagttcctcggcaacgtctccggcgagccctacacgctgcacaccaacgtgttcaccggcggccagggccagcgcgagcagcagttccgcctctggttcgaccccaccaaggacttccacacctactccgtggtgtggaacccgcagcacgtgatcttcgccgtggacggcaccccgatccgcgacttcaagaaccatgaggcccgcggggtggggttcccgcggacgcagccgatgcggctgtacgcgagtctctggaacgccgacgactgggccacgcagggcggccgcgtcaaggcggactggacgcaggcgccgttcgtcgcgtcgttccgtgggttcagcgctgacgcgtgtgtgtgggcgaatgggaagcagcagtgccctgtgggaaccatggcggcggcggcgacggggggacggcgcggaggccctggcagctggtggaaccagcagcttagtgacatgagctaccgccgcatgcgctgggtgcagaggaagttcatgatctacaactactgcaccgacgccaagcggttcccgcagggggtgcccgccgagtgcaagctccggtga

SEQ ID NO: 643 - protein, 292 aa, Sorghum bicolor
  REGION 1..292: note = Ceres Annot ID no. 8744420
  REGION 24..205: note = Pfam Name: Glyco_hydro_16 Pfam Description: Glycosyl hydrolases family 16
  REGION 229..289: note = Pfam Name: XET_C Pfam Description: Xyloglucan endo-transglycosylase (XET)
  REGION 1..292: note = Bit score of 713.5 for HMM based on sequences of Figure 11
  REGION 1..292: note = Functional Homolog Of SEQ ID NO. 641
  REGION 1..292: note = Figure 11
MRSTALVAFVAVACLAAVAHGGNFYKDTEMTWGQGRGKVVDGGRGLDLTLDRTSGSGFQSKSEYLFGKIDMQIKLVPGNSAGTVTTFYLSSQGPTHDEIDFEFLGNVSGEPYTLHTNVFTGGQGQREQQFRLWFDPTKDFHTYSVVWNPQHVIFAVDGTPIRDFKNHEARGVGFPRTQPMRLYASLWNADDWATQGGRVKADWTQAPFVASFRGFSADACVWANGKQQCPVGTMAAAATGGRRGGPGSWWNQQLSDMSYRRMRWVQRKFMIYNYCTDAKRFPQGVPAECKLR

SEQ ID NO: 644 - DNA, 1267 bp, Zea mays
  misc_feature 1..1267: note = Ceres Clone ID no. 331385
  misc_feature 1..1267: note = Encodes the peptide sequence at SEQ ID NO. 645
  source 1..1267: mol_type = other DNA
aagttccatatccaacacacacagcaacgctcgctcggcactgtcactagctagttgctctactagagggcgggtatagagctgcctgcaatccgccgctgagaagggaggatcggaagcgacgatgaggtcgtttgctcctgtctttctgtcggcggtcgtggcctggctggagctcgcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactccgctggcacggtcaccaccttctacctgtcgtcccagggcgacgcgcacgacgagatcgacttcgagttcctgggcaacgtgagcggggagccctacacgctgcacaccaacgtgttcacgcgcggacagggccagcgggagcagcagttccgcctctggttcgaccctaccactgccttccacacctactccatcctgtggaacccgcagcacgtgatcttcgcggtggacggcaccccggtgcgggacttcaagaaccacgaggcgcgcggggtggcgttcccgaggatgcagcccatgaggctgtacgccagcctgtggaacgccgacgactgggccacgcagggcgggcgcgtcaaggcggactggtccaaggcccccttcgtcgcctccttccgcggtttcagcgccgacgcctgcgtctgggacggcggcaggcagcgctgccctgagggcaccatggaggccgccgccgtcgcgggtgccggctccggccgcggctggtggaaccagcagctcagcgacatgagctaccgccgcatgcgctgggtgcagcgcaagttcatgatctacaactactgcgccgacgccaagcgcttcccgcagggcgtgcccgccgagtgcaagctccggtgagggagcgaggtttgttgggacgtccgtggggcatcaaaaccaagcacgatccctagtcgtggaaagtagaaaccaggcatcgattcgatcgtcgtcgacggtcttagtagtagctacttatttcgcagtgggcgatgaaagaatggtgtcatgtaaatgtagctctagtcgtgtcgcattctttgatttgttgtttcagcagcaccggatgtacaagtattgagtttgggctagcaagaataagtaatctttttcggc

SEQ ID NO: 645 - protein, 294 aa, Zea mays
  REGION 1..294: note = Ceres Clone ID no. 331385
  REGION 27..208: note = Pfam Name: Glyco_hydro_16 Pfam Description: Glycosyl hydrolases family 16
  REGION 232..291: note = Pfam Name: XET_C Pfam Description: Xyloglucan endo-transglycosylase (XET)
  REGION 1..294: note = Bit score of 707.4 for HMM based on sequences of Figure 11
  REGION 1..294: note = Functional Homolog Of SEQ ID NO. 641
  REGION 1..294: note = Figure 11
MRSFAPVFLSAVVAWLELAGTAQGGNFYQDTEMTWGDGRGKVVDGGRGLDLTLDRTSGSGFQSKSEYLFGKIDMQIKLVPGNSAGTVTTFYLSSQGDAHDEIDFEFLGNVSGEPYTLHTNVFTRGQGQREQQFRLWFDPTTAFHTYSILWNPQHVIFAVDGTPVRDFKNHEARGVAFPRMQPMRLYASLWNADDWATQGGRVKADWSKAPFVASFRGFSADACVWDGGRQRCPEGTMEAAAVAGAGSGRGWWNQQLSDMSYRRMRWVQRKFMIYNYCADAKRFPQGVPAECKLR

SEQ ID NO: 646 - protein, 293 aa, Oryza sativa
  REGION 1..293: note = Public GI ID no. 115469712
  REGION 23..204: note = Pfam Name: Glyco_hydro_16 Pfam Description: Glycosyl hydrolases family 16
  REGION 228..290: note = Pfam Name: XET_C Pfam Description: Xyloglucan endo-transglycosylase (XET)
  REGION 1..293: note = Bit score of 720.2 for HMM based on sequences of Figure 11
  REGION 1..293: note = Functional Homolog Of SEQ ID NO. 641
  REGION 1..293: note = Figure 11
  source 1..293: note = Oryza sativa subsp. japonica
MRTVALGIVAMACLVAIAHGGNFFQDAEVSWGQGRGKIVDGGRGLDLTLDRSSGSGFQSKSEYLFGKIDMQIKLVPGNSAGTVTTFYLSSQGSTHDEIDFEFLGNVTGEPYTLHTNVFTQGQGQREQQFRLWFDPTQSFHTYSIIWNPQHVIFAVDGTPIRDFKNHEARGVAFPKSQPMRVYASLWNADDWATQGGRVKADWSKAPFVASFRDFNADACVWSNGAQRCPVGTMETVAAPAGGRRGGAGGWWNQELSDMSYRRMRWVQRKFMIYNYCTDAKRFPQGTPAECKLR

SEQ ID NO: 647 - protein, 286 aa, Hordeum vulgare
  REGION 1..286: note = Public GI ID no. 1890577
  REGION 23..204: note = Pfam Name: Glyco_hydro_16 Pfam Description: Glycosyl hydrolases family 16
  REGION 228..283: note = Pfam Name: XET_C Pfam Description: Xyloglucan endo-transglycosylase (XET)
  REGION 1..286: note = Bit score of 718.3 for HMM based on sequences of Figure 11
  REGION 1..286: note = Functional Homolog Of SEQ ID NO. 641
  REGION 1..286: note = Figure 11
MRTVELGIVAMACLVAVARAGNFFQDSEMSWGDGRGKVVDGGRGLDLTLDKTSGSGFQSKSEYLFGKIDMQIKLVPGNSAGTVTTFYLSSQGTAHDEIDFEFLGNVTGEPYTLHTNVFAQGQGQREQQFRLWFDPTKAFHTYSIIWNPQHVIFAVDGTAIRDFKNHEARGVSFPKSQPMRLYASLWNADDWATQGGRVKTDWSKAPFVASFRNFNADACVMSGGAQRCPAGTMEASAAGGGSWWNQELSGMGYRRMRWVQRKFMIYNYCTDPKRVAQGVPAECKLR

SEQ ID NO: 648 - protein, 287 aa, Triticum aestivum
  REGION 1..287: note = Public GI ID no. 51039064
  REGION 23..204: note = Pfam Name: Glyco_hydro_16 Pfam Description: Glycosyl hydrolases family 16
  REGION 228..284: note = Pfam Name: XET_C Pfam Description: Xyloglucan endo-transglycosylase (XET)
  REGION 1..287: note = Bit score of 718.1 for HMM based on sequences of Figure 11
  REGION 1..287: note = Functional Homolog Of SEQ ID NO. 641
  REGION 1..287: note = Figure 11
MRTVAIGILAMACLVAVARGGNFFQDSEMTWGDGRGKVVDGGRGLDLTLDKTSGSGFQSKTEYLFGKIDMQIKLVPGNSAGTVTTFYLSSQGTAHDEIDFEFLGNVTGEPYTLHTNVFAKGQGQREQQFRLWFDPTKAFHTYSIIWNPQHVIFAVDGTAIRDFKNHEARGVSFPKSQPMRLYASLWNADDWATQGGRVKTDWSKAPFVASFRNFNADACVMSGGAQRCPAGTMEASAAGGSGSWWNQELSGMGYRRMRWVQRKFMIYNYCTDPKRVAQGVPAECKLR

SEQ ID NO: 649 - protein, 291 aa, Festuca pratensis
  REGION 1..291: note = Public GI ID no. 14330332
  REGION 24..206: note = Pfam Name: Glyco_hydro_16 Pfam Description: Glycosyl hydrolases family 16
  REGION 230..284: note = Pfam Name: XET_C Pfam Description: Xyloglucan endo-transglycosylase (XET)
  REGION 1..291: note = Bit score of 682.8 for HMM based on sequences of Figure 11
  REGION 1..291: note = Functional Homolog Of SEQ ID NO. 641
  REGION 1..291: note = Figure 11
MARMAVSVLAILLASCAVAAAASFDKEFDITWGDGRGKILNNGQLLTLGLDKTSGSGFQSKREYLFGKIDMQLKLVAGQLPPAPSPPTTCRSMGATHDKIDFEFLGNVTGEPYTLHTNVFAKGQGKREQQFRLWFDPTKAFHTYSIVWNPQHVIFAVDGTPIRDFKNHEARGVSFPKNQPMRLYASLWNADDWATQGGRVKTDWSHAPFVASFRGFSADACVMSGGAQRCPAGTMDASGTGSSWWNQELGDMSYRRMRWVQRKFMIYNYCTDPKRVAEGLPAECKIRLRSK

SEQ ID NO: 650 - protein, 287 aa, Vitis vinifera
  REGION 1..287: note = Public GI ID no. 147854712
  REGION 22..203: note = Pfam Name: Glyco_hydro_16 Pfam Description: Glycosyl hydrolases family 16
  REGION 227..281: note = Pfam Name: XET_C Pfam Description: Xyloglucan endo-transglycosylase (XET)
  REGION 1..287: note = Bit score of 709.0 for HMM based on sequences of Figure 11
  REGION 1..287: note = Functional Homolog Of SEQ ID NO. 641
  REGION 1..287: note = Figure 11
  VARIANT 14: note = X can be any amino acid
MASSSILVLMLSMXVVASAGNFNQDFDITWGDGRAKILNNGQLLTLSLDKASGSGFQSRNEYLFGKIDMQLKLVPGNSAGTVTAYYLSSQGPTHDEIDFEFLGNLSGDPYILHTNVFSQGKGNREQQFYLWFDPTADFHTYSILWNPQRIIFSVDGTPIREFKNSESIGVSYPKNQPMRIYSSLWNADDWATRGGLVKTDWSQAPFTASYRNFNADACIWSSGASSCSSTTPSSTSTSGQWYSQELDSTSQERMKWVQKNYMIYNYCTDTKRFPQGLPPECTATTLS

SEQ ID NO: 651 - protein, 297 aa, Vitis vinifera
  REGION 1..297: note = Public GI ID no. 157352236
  REGION 32..213: note = Pfam Name: Glyco_hydro_16 Pfam Description: Glycosyl hydrolases family 16
  REGION 237..291: note = Pfam Name: XET_C Pfam Description: Xyloglucan endo-transglycosylase (XET)
  REGION 1..297: note = Bit score of 698.9 for HMM based on sequences of Figure 11
  REGION 1..297: note = Functional Homolog Of SEQ ID NO. 641
  REGION 1..297: note = Figure 11
MAPICSSSSAVSTALLMSVVVSFLMAASAGNFYQDFDITWGDGRGKILNNGELLTLSLDKPSGSGFQSKNEYLFGKIDMQLKLVPGNSAGTVTAYYLSSQGPTHDEIDFEFLGNLSGDPYILHTNVFSQGKGNREQQFYLWFDPTADFHTYSILWNPQRIIFSVDGTPIREFKNSESIGVPYPKNQPMRIYSSLWNADDWATRGGLVKTDWSQAPFTASYRNFNANACLWSSGSSSCSSTSPSSTSTNGGWYSQELDSTSQERMKWVQKNYMIYNYCADTKRFPQGLPPECSATTMS

SEQ ID NO: 652 - protein, 280 aa, Musa acuminata
  REGION 1..280: note = Public GI ID no. 118722746
  REGION 21..202: note = Pfam Name: Glyco_hydro_16 Pfam Description: Glycosyl hydrolases family 16
  REGION 226..277: note = Pfam Name: XET_C Pfam Description: Xyloglucan endo-transglycosylase (XET)
  REGION 1..280: note = Bit score of 692.2 for HMM based on sequences of Figure 11
  REGION 1..280: note = Functional Homolog Of SEQ ID NO. 641
  REGION 1..280: note = Figure 11
MAMRFLLVACSLVAIASAGNFYQEFDVTWGGDRAKNLDNGQLLTLSLDKASGSGFQSKNQYLFGKIDMQIKLVPGNSAGTVTAYYLSSQGPTHDEIDFEFLGNPSGDPYTLHTNVFTQGKGNREMQFKLWFDPTEDFHTYSILWNPRHVIFMVDGTPIRDFKNLESRGIAFPNSQPMRIYSSLWNADDWATRGGLVKTDWSKAPFTASYRNFKADTCVPSSATTECASNSVPSNGGWWNQELDSMGQQRMKWVQKNYMIYNYCSDLKRFSQGLPPECSIA

SEQ ID NO: 653 - protein, 284 aa, Asparagus officinalis
  REGION 1..284: note = Public GI ID no. 8886867
  REGION 22..203: note = Pfam Name: Glyco_hydro_16 Pfam Description: Glycosyl hydrolases family 16
  REGION 227..281: note = Pfam Name: XET_C Pfam Description: Xyloglucan endo-transglycosylase (XET)
  REGION 1..284: note = Bit score of 703.8 for HMM based on sequences of Figure 11
  REGION 1..284: note = Functional Homolog Of SEQ ID NO. 641
  REGION 1..284: note = Figure 11
MASLLFAVLALSSVGIAVAGNFNDDFKITWGDGRGRIVDNGQLLSLSLDKASGSGFESTHEYLFGKIDMQLKLVPGNSAGTVTAYYLSSQGPTHDEIDFEFLGNLSGDPYTLHTNVFTQGKGNREQQFHLWFDPTKDFHTYSILWNPSHIIFSVDGIPIRDFKNMESRGVAFPKSQPMKIYSSLWNADDWATRGGLIKTDWTKAPFTASYRNFNANACVWSAGTSTCSSKKSPSASPSNAWLNEELDSTRQERMRWVQKNYMIYNYCADLKRFPQGLPPECSVA

SEQ ID NO: 654 - protein, 287 aa, Cucumis melo
  REGION 1..287: note = Public GI ID no. 115334952
  REGION 27..208: note = Pfam Name: Glyco_hydro_16 Pfam Description: Glycosyl hydrolases family 16
  REGION 232..283: note = Pfam Name: XET_C Pfam Description: Xyloglucan endo-transglycosylase (XET)
  REGION 1..287: note = Bit score of 677.9 for HMM based on sequences of Figure 11
  REGION 1..287: note = Functional Homolog Of SEQ ID NO. 641
  REGION 1..287: note = Figure 11
MAPPPSFSSLLLFLSLLSVSSVFCSNFYNDFEITWGNDRAKILNNGDLLTLSLDRGSGSGFQSKNVYLYGKIDMQLKLVPGNSAGTVTTYYLKSQGSTWDEIDFEFLGNLSGDPYTLHTNVYTQGKGDREQQFHLWFDPTSDFHTYSILWNPQGIIFSVDGTPIRKFKNHESSGVLFPKKQPMRLYSSLWNADDWATRGGLVKTDWSKAPFTASYRNFNADVCVWSGGVSSCSSGGNVGGRGWLSENLDITRQQRMKWVQRNYMIYNYCTDAKRFPQGYPPECAIAP

SEQ ID NO: 655 - DNA, 1176 bp, Panicum virgatum
  misc_feature 1..1176: note = Ceres Clone ID no. 1789502
  misc_feature 1..1176: note = Encodes the peptide sequence at SEQ ID NO. 656
  source 1..1176: mol_type = other DNA
atcccaccaatctactcgatcagtgaccacctccgatcctcaaccgagctcccaacgcttccgtactctcgctagctagagcagctactgcctgcaacaatcagctgagaagaagaagatgaggtcgttggcggtcgccgtcgcggcgatggcctgcctggcggcggtggcgcgggccggcaacttctaccaggacacggagatgacctggggcggcgggcgcggcaaggtcgtggacggcgggcgcgggctcgacctcacgctggaccgcacctccggctccgggttccagtccaagagcgagtacctcttcggcaagatcgacatgcagatcaagctggtccccggcaactccgccggcaccgtcaccaccttctacctctcgtcgcaggggagcacccacgacgagatcgacttcgagttcctgggcaacgtcaccggcgagccctacacgctgcacaccaacgtgttcacgcgagggcagggccagcgcgagcagcagttccgcctctggttcgaccccaccacggcctaccacacctactccatcgtctggaacccgcagcacatcatcttcgcggtggacggcaccccgatccgtgacttcaagaaccacgaggcgcgcggcgtggcgttccccaagagccagccgatgcggctgtacgcgagcctgtggaacgccgacgactgggcgacgcagggcgggcgcgtgaaggcggactggtcccacgcgccgttcgtggcctccttccggggcttccgcgccgacgcctgcgtctggtccggcggccggcagcagtgccccgtgggcaccatggaggccgccgcccgcggctggtggagccagcagctgagcgacacgagctaccgccgcatgcgctgggtgcagaggaagttcatgatctacaactactgcaccgacgccaagcgcttcccgcagggcgtccccgccgagtgccacctccggtgagctgctagcggctgccgcagtgccgtgcacgcacgatggttcctcgccgtcccaacccatcgcatcatggagaagaataaggatcgtttttgcatgatggggccgggcgatgtacaatgtaaatgtagcagcagcgcgcgtatcgcattctttgatttgtttctgtaacaccagatgtgcacctgtcatcaagtttctttcagcat

SEQ ID NO: 656 - protein, 283 aa, Panicum virgatum
  REGION 1..283: note = Ceres Clone ID no. 1789502
  REGION 23..204: note = Pfam Name: Glyco_hydro_16 Pfam Description: Glycosyl hydrolases family 16
  REGION 228..280: note = Pfam Name: XET_C Pfam Description: Xyloglucan endo-transglycosylase (XET)
  REGION 1..283: note = Bit score of 718.0 for HMM based on sequences of Figure 11
  REGION 1..283: note = Functional Homolog Of SEQ ID NO. 641
MRSLAVAVAAMACLAAVARAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTRGQGQREQQFRLWFDPTTAYHTYSIVWNPQHIIFAVDGTPIRDFKNHEARGVAFPKSQPMRLYASLWNADDWATQGGRVKADWSHAPFVASFRGFRADACVWSGGRQQCPVGTMEAAARGWWSQQLSDTSYRRMRWVQRKFMIYNYCTDAKRFPQGVPAECHLR

SEQ ID NO: 657 - DNA, 1182 bp, Panicum virgatum
  misc_feature 1..1182: note = Ceres Clone ID no. 1805428
  misc_feature 1..1182: note = Encodes the peptide sequence at SEQ ID NO. 658
  source 1..1182: mol_type = other DNA
atcccaccaatccactcgatcagtgaccacctccgatcctcaaccgagctcccaacgctcccgaactctcgctagctagagcagctgctgcctgcaacaatcagctgagaagaagatgaggtcgttcgcggtcgccgtcgcggcgatggcctgcctggcggcggtggcgcgggccggcaacttctaccaggacacggagatgacctggggcggcgggcgcggcaaggtcgtggacggcgggcgcgggctcgacctcacgctggaccgcacctccggctctgggttccagtccaagagcgagtacctcttcggcaagatcgacatgcagatcaagctggtccccggcaactccgccggcaccgtcaccaccttctacctctcgtcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccacggcctaccacacctactccatcgtctggaacccgcagcacatcatcttcgcggtggacggcaccccgatccgtgacttcaagaaccacgaggcgcacggcgtggcgttccccaagagccagccgatgcggctgtacgcgagcctgtggaacgccgacgactgggcgacgcagggcgggcgcgtgaaggcggactggtcccacgcgccgttcgtggcctccttccggggcttccgcgccgacgcctgcgtctggtccggcggccggcagcagtgccccgtgggcaccatggaggccgccgccgcgggcggcgggcgcggctggtggagccagcagctgagcgacacgagctaccgccgcatgcgctgggtgcagaggaagttcatgatctacaactactgcaccgacgccaagcgcttcccgcagggcgtccccgccgagtgccacctccggtgagctgctagcggggctgccgcagtgccgtgcacgcacgatggttcgtcgccgtcccaacccatcgcatcatggcgaagaataaggatcgtttttgcatgatggggccgggcgatgtacaatgtaaatgtagcagcagcgcgcgtatcgcattctttgatttgtttctgtaacaccagatgtgcacctgtcatcaagtttctttc

SEQ ID NO: 658 - protein, 287 aa, Panicum virgatum
  REGION 1..287: note = Ceres Clone ID no. 1805428
  REGION 23..204: note = Pfam Name: Glyco_hydro_16 Pfam Description: Glycosyl hydrolases family 16
  REGION 228..284: note = Pfam Name: XET_C Pfam Description: Xyloglucan endo-transglycosylase (XET)
  REGION 1..287: note = Bit score of 720.7 for HMM based on sequences of Figure 11
  REGION 1..287: note = Functional Homolog Of SEQ ID NO. 641
MRSFAVAVAAMACLAAVARAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEAHGVAFPKSQPMRLYASLWNADDWATQGGRVKADWSHAPFVASFRGFRADACVWSGGRQQCPVGTMEAAAAGGGRGWWSQQLSDTSYRRMRWVQRKFMIYNYCTDAKRFPQGVPAECHLR

SEQ ID NO: 659 - DNA, 1196 bp, Panicum virgatum
  misc_feature 1..1196: note = Ceres Clone ID no. 1724099
  misc_feature 1..1196: note = Encodes the peptide sequence at SEQ ID NO. 660
  source 1..1196: mol_type = other DNA
ccaacaatccactcgatcagtgacaacctcctcaaccgagctcccagcacttcgcgaactctcgctagctagagctgctgctgcctccaacgatcagctgagaagaagatgaggtcgttggcggtcgccgtcgcggcgatggcctgcctggcggcggtggcgcaggccggcaacttctaccaggacacggagatgacctggggcggcgggcgcggcaaggtcgtggacggcgggcgcgggctcgacctcacgctggaccgcacctccggctccgggttccagtccaagagcgagtacctcttcggcaagatcgacatgcagatcaagctggtccccggcaactccgccggcaccgtcaccaccttctacctctcgtcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccacggcctaccacacctactccatcgtctggaacccgcagcacatcatcttcgcggtggacggcaccccgatccgtgacttcaagaaccacgaggcgcgcggcgtggcgttccccaagagccagccgatgcggctgtacgcgagcctgtggaacgccgacgactgggcgacgcagggcgggcgcgtgaaggcggactggtcccacgcgccgttcgtggcctccttccggggcttccgcgccgacgcctgcgtctggtccggcggccggcagcagtgccccgtgggcaccatggaggccgccgccgcgggcggcgggcgcggctggtggagccagcagctgagcgacacgagctaccgccgcatgcgctgggtgcagaggaagttcatgatctacaactactgcaccgacgccaagcgcttcccgcagggcgtccccaccgagtgccacctccggtgagctgctagaggctgccgcagtgccgtgcacgcacgatggctcctcgccgtcccaacccatcgcatcatggagaagaataagggtcgtttttgcatgatggggccgggcgatgtacaatgtaaatggagcagcacgcgtatcgcattctttgatttgtttctgtaacaccagatgtgcacctgtcatcaagtttctttcagcataatcttccgtcagcgtcctcg

SEQ ID NO: 660 - protein, 287 aa, Panicum virgatum
  REGION 1..287: note = Ceres Clone ID no. 1724099
  REGION 23..204: note = Pfam Name: Glyco_hydro_16 Pfam Description: Glycosyl hydrolases family 16
  REGION 228..284: note = Pfam Name: XET_C Pfam Description: Xyloglucan endo-transglycosylase (XET)
  REGION 1..287: note = Bit score of 720.7 for HMM based on sequences of Figure 11
  REGION 1..287: note = Functional Homolog Of SEQ ID NO. 641
MRSLAVAVAAMACLAAVAQAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEARGVAFPKSQPMRLYASLWNADDWATQGGRVKADWSHAPFVASFRGFRADACVWSGGRQQCPVGTMEAAAAGGGRGWWSQQLSDTSYRRMRWVQRKFMIYNYCTDAKRFPQGVPTECHLR

SEQ ID NO: 661 - DNA, 1257 bp, Panicum virgatum
  misc_feature 1..1257: note = Ceres Clone ID no. 1724817
  misc_feature 1..1257: note = Encodes the peptide sequence at SEQ ID NO. 662
  source 1..1257: mol_type = other DNA
cattccaatcgcaccaatccactcgatcagtgaccaccacctcctcaccgagctcccaacaacacttggcaagctagacctccttcctgctgcctgcaatcagctgagaacgaagggaagaggatgaggtcgattgcgctcgccatcgcggcgatggcctgcctggcggcggtggcgcgggccggcaacttctaccaggacacggagatgacctggggcggcgggcgcggaaaggtcgtggacggcggccgcgggctcgacctgacgctggaccgcacctccggctccgggttccagtccaggagcgagtacctcttcggcaagatcgacatgcagatcaagctggtccccggcaactccgccggcaccgtcaccaccttctacctctcgtcgcaggggagcgcccacgacgagatcgacttcgagttcctgggcaacgtcaccggcgagccctacacgctgcacaccaacgtgttcacgcaggggcagggccaacgcgagcagcagttccgcctctggttcgaccccaccaccgcctaccacacctactccatcgtctggaacccgcagcacatcatcttcgcggtggacggcaccccgatccgcgacttcaagaaccacgaggcgcgcggcgtggcgttccccaagagccagccgatgcggctgtacgcgagcctgtggaacgccgacgactgggccacgcagggcgggcgcgtcaaggcggactggtcccacgcgccgttcgtggcctccttccggggcttccgcgccgacgcctgcgtgtggtccggcgggcggcagcagtgccccgtgggcaccatggaggccgccgccgcgggcggcggggggcgcggctggtggagccagcagctgagcgacatgagctaccgccgcatgcgctgggtgcagaggaagttcatgatctacaactactgcgccgacgccaaacgcttcccgcagggcgtccccgccgagtgccacctccggtgatgagcttgctagctgctgccgttgtgccgtgcacgcacgatgacgccttgtcgttccaacccaacccatccatccgtggcgaaaccagagatcgatcgtggagagaagaagatggtggcgaagaataaggatcgtttttggatgatggaggcgatgtaatgtactagtgtaaaggaaagggaatgtagctgcgcatatcgcattctttgatttgtttctgtaacaccagatgtacacctatcatcaagacgtttgtttcagcatact

SEQ ID NO: 662 - protein, 288 aa, Panicum virgatum
  REGION 1..288: note = Ceres Clone ID no. 1724817
  REGION 23..204: note = Pfam Name: Glyco_hydro_16 Pfam Description: Glycosyl hydrolases family 16
  REGION 228..285: note = Pfam Name: XET_C Pfam Description: Xyloglucan endo-transglycosylase (XET)
  REGION 1..288: note = Bit score of 719.3 for HMM based on sequences of Figure 11
  REGION 1..288: note = Functional Homolog Of SEQ ID NO. 641
MRSIALAIAAMACLAAVARAGNFYQDTEMTWGGGRGKVVDGGRGLDLTLDRTSGSGFQSRSEYLFGKIDMQIKLVPGNSAGTVTTFYLSSQGSAHDEIDFEFLGNVTGEPYTLHTNVFTQGQGQREQQFRLWFDPTTAYHTYSIVWNPQHIIFAVDGTPIRDFKNHEARGVAFPKSQPMRLYASLWNADDWATQGGRVKADWSHAPFVASFRGFRADACVWSGGRQQCPVGTMEAAAAGGGGRGWWSQQLSDMSYRRMRWVQRKFMIYNYCADAKRFPQGVPAECHLR

SEQ ID NO: 663 - DNA, 1253 bp, Panicum virgatum
  misc_feature 1..1253: note = Ceres Clone ID no. 1804995
  misc_feature 1..1253: note = Encodes the peptide sequence at SEQ ID NO. 664
  source 1..1253: mol_type = other DNA
accaatccactcgatcagtgaccaccacctcctcaccgagctcccaacaacacttggcaagctagacctccttcctgctgcctgcaatcagctgagaacgaagggaagaggatgaggtcgattgcgctcgccatcgcggcgatggcctgcctggcggcggtggcgcgggccggcaacttctaccaggacacggagatgacctggggcggcgggcgcggaaaggtcgtggacggcggccgcgggctcgacctgacgctggaccgcacctccggctccgggttccagtccaggagcgagtacctcttcggcaagatcgacatgcagatcaagctggtccccggcaactccgccggcaccgtcaccaccttctacctctcgtcgcaggggagcgcccacgacgagatcgacttcgagttcctgggcaacgtcaccggcgagccctacacgctgcacaccaacgtgttcacgcaggggcagggccaacgcgagcagcagttccgcctctggttcgaccccaccaccgcctaccacacctactccatcgtctggaacccgcagcacatcatcttcgcggtggacggcaccccgatccgcgacttcaagaaccacgaggcgcgcggcgtggcgttccccaagagccagccgatgcggctgtacgcgagcctgtggaacgccgacgactgggccacgcagggcgggtgcgtcaaggcggactggtcccacgcgccgttcgtggcctccttccggggcttccgcgccgacgcctgcgtgtggtccggcgggcggcagcagtgccccgtgggcaccatggaggccgccgccgcgggcggcggggggcgcggctggtggagccagcagctgagcgacatgagctaccgccgcatgcgctgggtgcagaggaagttcatgatctacaactagtgcgcggacgccaagcgcttcccgcagggcgtccccgccgagtgccacctccggtgatgagcttgctagctgctgccgttgtgccgtgcacgcacgatgacgccttgtcgttccaacccaacccatccatccgtggcgaaaccagagatcgatcgtggagagatgaagatggtggcgaagaataaggatcgtttttggatgatgggggggatgtaatgttactagtgtaaaggaaagggaatgtagctgcgcatatcgcattctttgatttgtttctgtaacaccagatgtacacctatcgtgtttcagcatactaatcttctgtcagcgtc

SEQ ID NO: 664 - protein, 269 aa, Panicum virgatum
  REGION 1..269: note = Ceres Clone ID no. 1804995
  REGION 23..204: note = Pfam Name: Glyco_hydro_16 Pfam Description: Glycosyl hydrolases family 16
  REGION 228..269: note = Pfam Name: XET_C Pfam Description: Xyloglucan endo-transglycosylase (XET)
  REGION 1..269: note = Bit score of 633.1 for HMM based on sequences of Figure 11
  REGION 1..269: note = Functional Homolog Of SEQ ID NO. 641
MRSIALAIAAMACLAAVARAGNFYQDTEMTWGGGRGKVVDGGRGLDLTLDRTSGSGFQSRSEYLFGKIDMQIKLVPGNSAGTVTTFYLSSQGSAHDEIDFEFLGNVTGEPYTLHTNVFTQGQGQREQQFRLWFDPTTAYHTYSIVWNPQHIIFAVDGTPIRDFKNHEARGVAFPKSQPMRLYASLWNADDWATQGGCVKADWSHAPFVASFRGFRADACVWSGGRQQCPVGTMEAAAAGGGGRGWWSQQLSDMSYRRMRWVQRKFMIYN

SEQ ID NO: 665 - DNA, 1262 bp, Triticum aestivum
  misc_feature 1..1262: note = Ceres Clone ID no. 1446366
  misc_feature 1..1262: note = Encodes the peptide sequence at SEQ ID NO. 666
  source 1..1262: mol_type = other DNA
catcaaccagccaagagcagccagccattccaatccatcacaccatccaccaagctcagctcagctcagctcagctaccaacacttgactaggtagcagctagtgagaaagaaagatcgttggagcgcaagatgagggcggcggcgctcggcattgtggccatggcctgcctcgtggcggtggcgcggggcggcaacttcatccaggactccgagatgacctggggggacggccgcgggaaggtcgtcgacggcggccgcgggctcgacctcacgctcgacaagacctccggctccggcttccagtccaagagcgagtacctgttcggcaagattgacatgcagatcaagctcgtccccggcaactccgccggcaccgtcaccaccttctacctgtcgtcgcaggggacggcgcacgacgagatcgacttcgagttcctgggcaacgtgaccggcgagccctacacgctgcacaccaacgtgttcgcgcaggggcaggggcagcgggagcagcagttccgcctctggttcgaccccaccaaggccttccacacctactccatcatctggaacccgcagcacgtcatattcgcggtggacggcacggcgatcagggacttcaagaaccacgaggcgcgcggcgtgtcgttccccaagagccagccgatgcggctgtacgcgagcctgtggaacgccgacgactgggccacgcagggcggccgggtcaagaccgactggagcaaggcgccgttcgtcgcctccttccgcaacttcaacgccgacgcctgcgtcatgtcgggcggcgcgcagcgctgccccgcgggcaccatggaggcctcggccgccggcgccaacggcagcggcagctggtggaaccaggagctgagcggcatggggtaccggcgcatgcggtgggtgcagaggaagttcatgatctacaactactgcaccgaccccaagcgggtggcgcagggcgtgcccgccgagtgcaagctccgctgatgagatcccagctcccgcagctcacaagaacaacaacccaggaacccgtcggtcgtctgagatgtgtctggtttcggctttcgatccgtgagaacgaacgaaggaaggaagggaaagtgcgcgcgcatcgaagctctgtgggatggtgtaaatgtagtaccgtagtatgcatatcgcattctttcatttgtttcgttgtcacacggggtcgatccatgtacttatgcaagttctataattagcctgttccgtttagccttg

SEQ ID NO: 666 - protein, 289 aa, Triticum aestivum
  REGION 1..289: note = Ceres Clone ID no. 1446366
  REGION 23..204: note = Pfam Name: Glyco_hydro_16 Pfam Description: Glycosyl hydrolases family 16
  REGION 228..286: note = Pfam Name: XET_C Pfam Description: Xyloglucan endo-transglycosylase (XET)
  REGION 1..289: note = Bit score of 716.3 for HMM based on sequences of Figure 11
  REGION 1..289: note = Functional Homolog Of SEQ ID NO. 641
MRAAALGIVAMACLVAVARGGNFIQDSEMTWGDGRGKVVDGGRGLDLTLDKTSGSGFQSKSEYLFGKIDMQIKLVPGNSAGTVTTFYLSSQGTAHDEIDFEFLGNVTGEPYTLHTNVFAQGQGQREQQFRLWFDPTKAFHTYSIIWNPQHVIFAVDGTAIRDFKNHEARGVSFPKSQPMRLYASLWNADDWATQGGRVKTDWSKAPFVASFRNFNADACVMSGGAQRCPAGTMEASAAGANGSGSWWNQELSGMGYRRMRWVQRKFMIYNYCTDPKRVAQGVPAECKLR

SEQ ID NO: 667 - DNA, 1262 bp, Triticum aestivum
  misc_feature 1..1262: note = Ceres Clone ID no. 1054422
  misc_feature 1..1262: note = Encodes the peptide sequence at SEQ ID NO. 668
  source 1..1262: mol_type = other DNA
atcaacaaaccaacccaaccagcaatagccaccccaatccatccagctcctccaagctcagtgtccgagctcagctcagctacccacacttcactcagtagcagctaccggtagcgagaaagaaagatcgatagtgcgacgtgcgcgatgacgacggtggcgataggcattctggccatggcgtgcctcgtggcggtggcgcggggcggcaacttcttccaggactccgagatgacctggggggacggccgcggcaaggtcgtcgacggcggccgcgggctcgacctcacgctcgacaagacctccggctccggcttccagtccaagaccgagtacctcttcggcaagatcgacatgcagatcaagctcgtccccggcaactccgccggcaccgtcaccaccttctacctgtcgtcgcaggggacggcgcacgacgagatcgacttcgagttcctgggcaacgtcaccggcgagccctacacgctgcacaccaacgtgttcgcgaaagggcaggggcagcgggagcagcagttccgcctctggttcgaccccaccaaggccttccacacctactccatcatctggaacccgcagcacgtcatattcgcggtggacggcacggcgatcagggacttcaagaaccacgaggcgcgcggcgtgtcgttccccaagagccagccgatgcggctgtacgcgagcctgtggaacgccgacgactgggccacgcagggcggccgggtcaagaccgactggagcaaggcgccgttcgtcgcctccttccgcaacttcaacgccgacgcctgcgtcatgtcgggcggcgcgcagcgctgccccgccggcacaatggaggcctctgcggccggcggcagcggcagctggtggaaccaggagctcagcggcatgggctaccgccgcatgcggtgggtgcagaggaagttcatgatctacaactactgcaccgaccccaagcgggtggcgcagggcgtgcctgccgagtgcaagctccgctgatgagatcctcccgcagcttacaagaacaacaacgcatgaacccgtcatctgagatgtgttttgtttcggctttcgatccgtgagaacgaaggaaggaaggaagtgcgcgcatcagagctctgtcggatggtgtaaatgtagtaccgtagtatgcatatcgcattctttcatttgtttcgttgtcacacgggtcgttccatgtacttatgcaagttctataattagctagttccttttagccttgaaaatcc

SEQ ID NO: 668 - protein, 287 aa, Triticum aestivum
  REGION 1..287: note = Ceres Clone ID no. 1054422
  REGION 23..204: note = Pfam Name: Glyco_hydro_16 Pfam Description: Glycosyl hydrolases family 16
  REGION 228..284: note = Pfam Name: XET_C Pfam Description: Xyloglucan endo-transglycosylase (XET)
  REGION 1..287: note = Bit score of 716.2 for HMM based on sequences of Figure 11
  REGION 1..287: note = Functional Homolog Of SEQ ID NO. 641
MTTVAIGILAMACLVAVARGGNFFQDSEMTWGDGRGKVVDGGRGLDLTLDKTSGSGFQSKTEYLFGKIDMQIKLVPGNSAGTVTTFYLSSQGTAHDEIDFEFLGNVTGEPYTLHTNVFAKGQGQREQQFRLWFDPTKAFHTYSIIWNPQHVIFAVDGTAIRDFKNHEARGVSFPKSQPMRLYASLWNADDWATQGGRVKTDWSKAPFVASFRNFNADACVMSGGAQRCPAGTMEASAAGGSGSWWNQELSGMGYRRMRWVQRKFMIYNYCTDPKRVAQGVPAECKLR

SEQ ID NO: 669 - DNA, 1184 bp, Zea mays
  misc_feature 1..1184: note = Ceres Clone ID no. 263803
  misc_feature 1..1184: note = Encodes the peptide sequence at SEQ ID NO. 670
  source 1..1184: mol_type = other DNA
atcccaacccactcacagtctcacgctactatcgctatctagagctccggccgtcacagacacgagctagagctagagctgcagggaagaagaagaaggaggaggaggagaagatgagggcgtccgcgctggtctgcttcgtggcggtgtcggcgtgcatagcgtgcatcgcgcatggcggcaacttctaccaggacacggagatgacctgggggcaggggcgcggcaaggtggtggacggcgggcgcgggctggacctgagcctggacagggcctccgggtccgggttccagtccaaggacgagtacctgttcggcaagatcgagatgcagatgaagctggtgcctggcaactcggcgggcaccgtgacgaccttgtacctgtcgtcgcagggcgacgcgcacgacgagatcgacctggagttcctgggcaacgtgtcgggcgagccctacacgctgcacacgaacgtgttcacgcgcgggcgggggcagcgggagcagcagttccgcctctggttcgaccccaccgccgacttccacacctactccgtggtgtggaacccgcggcacgtcatcttcgcggtggacggcacgccggtgagggacttcgccaaccgcgaggcccgcggggtggcgttcccgcggacgcagcccatgcgggtgtacgccagcctctggaacgccgacgactgggccacgcagggcggccgcgtcaaggcggactgggcgcgggcgccgttcgtcgcctcgttccgcgggttcagcgccgacgcctgcgtctggtccggcggcaggtcgcagtgccccgtcggcaccatggaggaggcgggaggaggcggcggctggtggaaccagcagctcascgacgccagctaccgccgcatgcgctgggtgcaraggaagttcatgatytacaactactgcaccgacgccaagcggttcccgcagggccggggcgtgcccgctgaatgcaggctccggcgataaaggtggctggatgagcgaacgcgaagccacctgcgtgcgtgcacgacgatcgatcccctcgtcgtcgttcacttcagaccagagatcggtggtctggcgaataatgtttgggtttttttttttgccatgggcgatggcaatgtaaatgtagcacgtgacgcacgtcgcagtgatattctttcatctgttttctgcagc

SEQ ID NO: 670 - protein, 290 aa, Zea mays
  REGION 1..290: note = Ceres Clone ID no. 263803
  REGION 25..206: note = Pfam Name: Glyco_hydro_16 Pfam Description: Glycosyl hydrolases family 16
  REGION 230..286: note = Pfam Name: XET_C Pfam Description: Xyloglucan endo-transglycosylase (XET)
  REGION 1..290: note = Bit score of 665.8 for HMM based on sequences of Figure 11
  REGION 1..290: note = Functional Homolog Of SEQ ID NO. 641
  VARIANT 250: note = X can be any amino acid
  VARIANT 261: note = X can be any amino acid
  VARIANT 266: note = X can be any amino acid
MRASALVCFVAVSACIACIAHGGNFYQDTEMTWGQGRGKVVDGGRGLDLSLDRASGSGFQSKDEYLFGKIEMQMKLVPGNSAGTVTTLYLSSQGDAHDEIDLEFLGNVSGEPYTLHTNVFTRGRGQREQQFRLWFDPTADFHTYSVVWNPRHVIFAVDGTPVRDFANREARGVAFPRTQPMRVYASLWNADDWATQGGRVKADWARAPFVASFRGFSADACVWSGGRSQCPVGTMEEAGGGGGWWNQQLXDASYRRMRWVXRKFMXYNYCTDAKRFPQGRGVPAECRLRR

SEQ ID NO: 671 - DNA, 1382 bp, Panicum virgatum
  misc_feature 1..1382: note = Ceres Clone ID no. 1821034
  misc_feature 1..1382: note = Encodes the peptide sequence at SEQ ID NO. 672
  source 1..1382: mol_type = other DNA
ctccctgtccctcctcgacccatcgctctgctccgccttcgcggcaggcaaccatccgatccaccacccggcagcgacgccattctcgcctccccaaaccccctataaaatccctcacaccccgcgcgttctccactcactcacacagcacaagaagcaagctcgatcgccgggccccttcgtccacctccaccaccacacatctcaccacagtcagagcgaccgcttcggccatggcccggcgggtgtcgtccctactgctgctgctgctgctgggcgcgctggcggcggcggcggcggccagcttcgaccaggatttcgacatcacctggggcgacggccgcggcaagatccaggacggcggccgcctcctcacgctcacgctcgaccgcacctccggctccggcttccagtccaggcgagagtacctcttcggcaagatcgacatgcagatcaagctcgtccccggcaactccgccggcaccgtcaccgcctactacctctcgtcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccaccgacttccacacctactccatcctctggaaccccaagcacatcatcttcatggtggacgacctgcccatcagggacttccggaacctggagagcaaggggatcgcgttccccaagagccagcccatgcgcctctactccagcctctggaacgctgacgactgggccacgcagggcgggcgcgtcaagacggactggtcccacgcgcccttctccgcctcctaccggggcttctgggccgacgcctgcgtcgccgtcgccggcggaaagacccgctgcggcgccgccgtcggcaccgagcgcgccgccgcccccgccggcgactggtacaaccaggagctcgacctcaccctgcagcagcgcatgcgctgggtgcagcgcaagtacatgatctacaactactgcaccgaccccaagcgatacccgcagggcctccccgccgagtgctccatgcagcagtagcccacctgtccaccattcccaaccgcgcgcgtcgagctccatcggctgcaatggcggatagatcatcatcggcgtcggtctcatcttctgtggggtaaataaataaggacctggcaaattcgatcgtgggacctgtaatgcatatgcagtagctggtggtaaattcttcctgtcttgtctgtagcctgtcgcctctgttctgttcgtgtcgccttgtaattgtaaccaactcgccgtgttcgtggccgtctgtaatataccgaaagccatacg

SEQ ID NO: 672 - protein, 291 aa, Panicum virgatum
  REGION 1..291: note = Ceres Clone ID no. 1821034
  REGION 25..206: note = Pfam Name: Glyco_hydro_16 Pfam Description: Glycosyl hydrolases family 16
  REGION 231..287: note = Pfam Name: XET_C Pfam Description: Xyloglucan endo-transglycosylase (XET)
  REGION 1..291: note = Bit score of 657.9 for HMM based on sequences of Figure 11
  REGION 1..291: note = Functional Homolog Of SEQ ID NO. 641
MARRVSSLLLLLLLGALAAAAAASFDQDFDITWGDGRGKIQDGGRLLTLTLDRTSGSGFQSRREYLFGKIDMQIKLVPGNSAGTVTAYYLSSQGSTHDEIDFEFLGNVTGEPYTLHTNVFTQGQGQREQQFRLWFDPTTDFHTYSILWNPKHIIFMVDDLPIRDFRNLESKGIAFPKSQPMRLYSSLWNADDWATQGGRVKTDWSHAPFSASYRGFWADACVAVAGGKTRCGAAVGTERAAAPAGDWYNQELDLTLQQRMRWVQRKYMIYNYCTDPKRYPQGLPAECSMQQ

SEQ ID NO: 673 - DNA, 1207 bp, Panicum virgatum
  misc_feature 1..1207: note = Ceres Clone ID no. 1806021
  misc_feature 1..1207: note = Encodes the peptide sequence at SEQ ID NO. 674
  source 1..1207: mol_type = other DNA
aagcaagctaagctcgatcgcccgcccgcccccttcgaccttcgtccagctccaccaccacacatctcggcatctcgccgcttcggccatggcccggcgggtgtccctgctgcagctgctgctgctgggcgcgctggcggcctgctcggcggcggcggcggcggccagcttcgaccaggagttcgacatcacctggggcgacggccgcggcaagatcgaggacggcggccgcctcctcacgctcacgctcgaccgcacctccggctccggcttccagtccaggcacgagtacctcttcggcaagatcgacatgcagctcaagctcgtccccggcaactccgccggcaccgtcaccgcctactacctctcctcccaggggagcgcccacgacgagatcgacttcgagttcctgggcaacgtctccggcgagccctacacgctgcacaccaacgtgttcacgcaggggcagggccagcgcgagcagcagttccgcctctggttcgaccccaccaccgacttccacacctactccatcctctggaatcccaagcacatcatcttcatggtggacgacctgccgatcagggacttccggaacctggagagcaaggggatcgcgttccccaagagccagcccatgcggctctactccagcctctggaacgccgacgactgggccacgcaggggggccgcgtcaagacggattggtcccacgcgcccttctccgcctcctaccggggcttccgggccgacgcctgcgtcgccgtcgccggcggcaggacccgctgcggcgccgccgtcggcaccgagggcgccgcgggcgccgccgcccccgccggtgactggtacaaccaggagctcgacctcaccctgcagcagcgcatgcgctgggtgcagcgcaagtacatgatctacaactactgcaccgaccccaagcgctaccagcagggcctccccgccgagtgctccatgcagcagtaatgctcctccatcggctgctgcaatggcggatgctagctgcacccccggatcatcaatcatcaatcgaagacgaagggcaaggaagaagcatgggggggggggggggggggcgtcgatcggtctcatcttctgtgtggtaaataaataaggacctggacctggcaaattcgatcgtgggacctgtaatgcgtgcagtagctggtggtaaattcctctgttctgtcc

SEQ ID NO: 674 - protein, 297 aa, Panicum virgatum
  REGION 1..297: note = Ceres Clone ID no. 1806021
  REGION 28..209: note = Pfam Name: Glyco_hydro_16 Pfam Description: Glycosyl hydrolases family 16
  REGION 234..293: note = Pfam Name: XET_C Pfam Description: Xyloglucan endo-transglycosylase (XET)
  REGION 1..297: note = Bit score of 641.2 for HMM based on sequences of Figure 11
  REGION 1..297: note = Functional Homolog Of SEQ ID NO. 641
MARRVSLLQLLLLGALAACSAAAAAASFDQEFDITWGDGRGKIEDGGRLLTLTLDRTSGSGFQSRHEYLFGKIDMQLKLVPGNSAGTVTAYYLSSQGSAHDEIDFEFLGNVSGEPYTLHTNVFTQGQGQREQQFRLWFDPTTDFHTYSILWNPKHIIFMVDDLPIRDFRNLESKGIAFPKSQPMRLYSSLWNADDWATQGGRVKTDWSHAPFSASYRGFRADACVAVAGGRTRCGAAVGTEGAAGAAAPAGDWYNQELDLTLQQRMRWVQRKYMIYNYCTDPKRYQQGLPAECSMQQ

SEQ ID NO: 675 - DNA, 1247 bp, Panicum virgatum
  misc_feature 1..1247: note = Ceres Clone ID no. 1727689
  misc_feature 1..1247: note = Encodes the peptide sequence at SEQ ID NO. 676
  source 1..1247: mol_type = other DNA
acacaacacaagcaagctaagctcgatcgcccgcccgcccccttcgaccttcgtccagctccaccaccacacatctcggcatctcgccgcttcggccatggcccggcgggtgtccctgctgctgctgggcgcgctggcggcctgctcggcggcggcggcggccagcttcgaccaggagttcgacatcacctggggcgacggccgcggcaagatccaggacggcggccgcctcctcacgctcacgctcgaccgcacctccggctccggcttccagtccaggcacgagtacctcttcggcaagatcgacatgcagctcaagctcgtccccggcaactccgccggcaccgtcaccgcctactacctctcctcccaggggagcgcccacgacgagatcgacttcgagttcctgggcaacgtctccggcgagccctacacgctgcacaccaacgtgttcacgcaggggcagggccagcgcaagcagcagttccgcctctggttcgaccccaccaccgacttccacacctactccatcctctggaatcccaagcacatcatcttcatggtggacgacctgccgatcagggacttccggaacctggagagcaaggggatcgcgttccccaagagccagcccatgcggctctactccagcctctggaacgccgacgactgggccacgcaggggggccgcgtcaagacggattggtcccacgcgcccttctccgcctcctaccggggcttccgggccgacgcctgcgtcaccgtcgccggcggcaggacccgctgcggcgccgccgtcggcaccgagggcgccgcgggcgccgccgcccccgccggcgactggtacaaccaggagctcgacctcaccctgcagcagcgcatgcgctgggtgcagcgcaagtacatgatctacaactactgcaccgaccccaagcgctaccagcagggcctccccgccgagtgctccatgcagcagtaatgctcctccatcggctgctgcaatggcggatgctagctgcaccaccggatcatcaatcatcaatcgaagacgaagggcaaggaagaagcatgggggggagtcgatcggtctaatcttctgtgtggtaatcgtgggacctgtaatgcgtgcagtagctggtggtaaattcctctgttctgtcctgttctgttggtgtcatcttgtaatcaacacgccgtgttcatgtccgtcttgtaatatacccaagaaagacatacgtgttcgtcag

SEQ ID NO: 676 - protein, 293 aa, Panicum virgatum
  REGION 1..293: note = Ceres Clone ID no. 1727689
  REGION 24..205: note = Pfam Name: Glyco_hydro_16 Pfam Description: Glycosyl hydrolases family 16
  REGION 230..289: note = Pfam Name: XET_C Pfam Description: Xyloglucan endo-transglycosylase (XET)
  REGION 1..293: note = Bit score of 645.4 for HMM based on sequences of Figure 11
  REGION 1..293: note = Functional Homolog Of SEQ ID NO. 641
MARRVSLLLLGALAACSAAAAASFDQEFDITWGDGRGKIQDGGRLLTLTLDRTSGSGFQSRHEYLFGKIDMQLKLVPGNSAGTVTAYYLSSQGSAHDEIDFEFLGNVSGEPYTLHTNVFTQGQGQRKQQFRLWFDPTTDFHTYSILWNPKHIIFMVDDLPIRDFRNLESKGIAFPKSQPMRLYSSLWNADDWATQGGRVKTDWSHAPFSASYRGFRADACVTVAGGRTRCGAAVGTEGAAGAAAPAGDWYNQELDLTLQQRMRWVQRKYMIYNYCTDPKRYQQGLPAECSMQQ

SEQ ID NO: 677 - protein, 290 aa, Oryza sativa
  REGION 1..290: note = Public GI ID no. 115469720
  REGION 21..202: note = Pfam Name: Glyco_hydro_16 Pfam Description: Glycosyl hydrolases family 16
  REGION 227..288: note = Pfam Name: XET_C Pfam Description: Xyloglucan endo-transglycosylase (XET)
  REGION 1..290: note = Bit score of 648.7 for HMM based on sequences of Figure 11
  REGION 1..290: note = Functional Homolog Of SEQ ID NO. 641
  source 1..290: note = Oryza sativa subsp. japonica
MAALLVVVLVAMSAMVATANFNQEFDITWGDGRGKILEDGQLLTLTLDRTSGSGFQSKHEYLYGKIDMQLKLVPGNSAGTVTAYYLSSQGPTHDEIDFEFLGNVTGEPYTLHTNVFTQGQGQREMQFRLWYDPTKDFHTYSILWNPKHIIFMVDDMPIRDFRNLEGKGIAFPKNQPMRLYSSLWNADDWATQGGRVKTDWTHAPFSASYRGFRADACVVAAGGRTRCGATVGTDAAPGTGAAAAAGGWYNQELDLTRQQRMRWVQSKYMIYNYCTDPKRFPQGVPAECSM

SEQ ID NO: 678 - DNA, 906 bp, Sorghum bicolor
  misc_feature 1..906: note = Ceres Annot ID no. 8744425
  misc_feature 1..906: note = Encodes the peptide sequence at SEQ ID NO. 679
  source 1..906: mol_type = other DNA
atggcgtctcgtcgtgtgtccctgctgctgggcgtactgctgtcctactccgccgccgtcgccgtcgccgtggcggcggccaacttcaaccaggagttcgacatcacgtggggcgacggtcgtggcaagatccaggacaacgggcagctgctgacgctgacgctggaccggacctccgggtccgggttccagtccaggcacgagtacctcttcggcaagatcgacatgcagctgaagctggtccccggcaactcggccggcaccgtcaccgcctactacctgtcgtcgcagggcaacacccacgatgagatcgacttcgagttcctcggcaacgtctccggcgagccctacacgctgcacaccaacgtgttcacccagggccagggacagagggagcagcagttccgcctctggtttgatcccaccaaggacttccatacctactccatcctctggaaccccaagcacgtcatcttcatggtggacgagatgccgatcagggacttccggaacctggagagcaagggggtggcgttccccaagaaccagccgatgcggctctactccagcctgtggaacgccgacgactgggcgacacagggcggccgcgtcaagacggactggtcccacgcgcccttctccgcctcgtaccggggattcagggccgacgcctgcgtcgcagtcgccggcggcaagacgcgctgcggcggcggcggcggcggcggcgccgtcggcaccgagggcgccggcgctggagcgccggccggggactggtacaaccaggagctggacctcacgctgcagcagcggatgcggtgggtgcagcgcaagtacatgatctacaactactgcaccgaccccaagcgctacccgcagggcctccccgccgagtgctccatgcagtag

SEQ ID NO: 679 - protein, 301 aa, Sorghum bicolor
  REGION 1..301: note = Ceres Annot ID no. 8744425
  REGION 29..210: note = Pfam Name: Glyco_hydro_16 Pfam Description: Glycosyl hydrolases family 16
  REGION 235..298: note = Pfam Name: XET_C Pfam Description: Xyloglucan endo-transglycosylase (XET)
  REGION 1..301: note = Bit score of 643.7 for HMM based on sequences of Figure 11
  REGION 1..301: note = Functional Homolog Of SEQ ID NO. 641
MASRRVSLLLGVLLSYSAAVAVAVAAANFNQEFDITWGDGRGKIQDNGQLLTLTLDRTSGSGFQSRHEYLFGKIDMQLKLVPGNSAGTVTAYYLSSQGNTHDEIDFEFLGNVSGEPYTLHTNVFTQGQGQREQQFRLWFDPTKDFHTYSILWNPKHVIFMVDEMPIRDFRNLESKGVAFPKNQPMRLYSSLWNADDWATQGGRVKTDWSHAPFSASYRGFRADACVAVAGGKTRCGGGGGGGAVGTEGAGAGAPAGDWYNQELDLTLQQRMRWVQRKYMIYNYCTDPKRYPQGLPAECSMQ

SEQ ID NO: 680 - protein, 298 aa, Zea mays
  REGION 1..298: note = Public GI ID no. 212275237
  REGION 28..209: note = Pfam Name: Glyco_hydro_16 Pfam Description: Glycosyl hydrolases family 16
  REGION 248..295: note = Pfam Name: XET_C Pfam Description: Xyloglucan endo-transglycosylase (XET)
  REGION 1..298: note = Bit score of 631.4 for HMM based on sequences of Figure 11
  REGION 1..298: note = Functional Homolog Of SEQ ID NO. 641
MATSSRRVPLLLLCLGVLVSCSFAAGSLDQELDITWGDGRGKVLDNGRLLTLSLDRTSGSGFQSRHEYLFGKIDMQLRLVPGNSAGTVTAYYLSSQGGAHDEIDFEFLGNVSGEPYTLHTNVFTRGQGQREQQFRLWFDPTADFHTYSILWNPKHVIFMVDDMPIRDFRNLESKGVAFPKSQPMRLYSSLWNADDWATQGGRVKTDWSHAPFSASYRGFKADACVAVAGGRTRCGATVGTEGTGAPASAAGAGDWYNQELDLTLQQRMRWVQRKYMIYNYCTDPKRYQQGLPAECSMQ

SEQ ID NO: 681 - DNA, 982 bp, Panicum virgatum
  misc_feature 1..982: note = Ceres Clone ID no. 1724271
  misc_feature 1..982: note = Encodes the peptide sequence at SEQ ID NO. 682
  source 1..982: mol_type = other DNA
agttgagtgtgctccctcaccaagcaaagcaacctcgctcgctctcccaatcatccttatcagatcatcttcttccaagatgtcttgcagctgcggatcaagctgcaactgcggctcccgctgcaactgcggcaagatgtacctctcgtcccaggggagcacccacgacgagatcgacttccagttcctgggcaacgtcaccggcgagccctacacgctgcacaccaacgtgtttacgcaggggcagggccagcgcgagcagcagttccgcctctggttcgaccccaccacggcctaccacacctactccatcgtctggaacccgcagcacatcatcttcgcggtggacggcaccccgatccatgacttcaagaaccacgaggcgcgcggcgtggcgttccccaagagccagccgatgcggctgtacgcgagcctgtggaacgccgacgactgggcgacgcagggcgggcgcgtgaaggcggactggtcccacgcgccgttcgtggcctccttccggggcttccgcgccgacgcctgcgtctggtccggcggccggcagcagtgccccgtgggcaccatggaggccgccgccgcgggcggcgggcgcggctggtggagccagcagctgagcgacacgagctaccgccgcatgcgctgggtgcagaggaagttcatgatctacaactactgcaccgacgccaagcgcttcccgcagggcgtccccaccgagtgccacctccggtgagctgctagcggctgccgcagtgccgtgcacgcacgatggttcctcgccgtcccaacccatcgcatcatggagaagaataagggtcgtttttgcatgatgggggcatggggccgggcgatgtacaatgtaaatggagcagcacgcgtatcgcattctttgatttgtttctgtaacaccagatgtgcacctgtcatcaagtttctttcagcataatcttccgtcagcgtccttgattcg

SEQ ID NO: 682 - protein, 221 aa, Panicum virgatum
  REGION 1..221: note = Ceres Clone ID no. 1724271
  REGION 5..138: note = Pfam Name: Glyco_hydro_16 Pfam Description: Glycosyl hydrolases family 16
  REGION 162..218: note = Pfam Name: XET_C Pfam Description: Xyloglucan endo-transglycosylase (XET)
  REGION 1..221: note = Bit score of 424.1 for HMM based on sequences of Figure 11
  REGION 1..221: note = Functional Homolog Of SEQ ID NO. 641
MSCSCGSSCNCGSRCNCGKMYLSSQGSTHDEIDFQFLGNVTGEPYTLHTNVFTQGQGQREQQFRLWFDPTTAYHTYSIVWNPQHIIFAVDGTPIHDFKNHEARGVAFPKSQPMRLYASLWNADDWATQGGRVKADWSHAPFVASFRGFRADACVWSGGRQQCPVGTMEAAAAGGGRGWWSQQLSDTSYRRMRWVQRKFMIYNYCTDAKRFPQGVPTECHLR

SEQ ID NO: 683 - DNA, 1395 bp, Zea mays
  misc_feature 1..1395: note = Ceres Clone ID no. 247073
  misc_feature 1..1395: note = Encodes the peptide sequence at SEQ ID NO. 684
  source 1..1395: mol_type = other DNA
aaaaaaacaagctcgaccaccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccttcaccgcctactacctgtcgtcgcagggcggcgcgcacgacgagatcgacttcgagttcctgggcaacgtgtccggcgagccctacacgctgcacaccaacgtgttcacgcgggggcaggggcagcgggagcagcagttccgcctctggttcgaccccaccgccgacttccacacctactccatcctctggaaccccaagcacgtcatcttcatggtggacgacatgcccatcagggacttccgcaacctggagagcaagggggtggcgttccccaagagccagccgatgcggctctactccagcctgtggaacgcggacgactgggcgacgcagggcgggcgcgtcaagacggactggtcccacgcccccttctccgcctcctaccgcgggttcaaggccgacgcttgcgtcgccgtcgcgggcggccggacccgctgcggcgccaccgtcggcaccgagggcaccggcgcccccgcctccgccgmcggcgccggggactggtacaaccaggagctggacctcaccctgcagcagcggatgcgctgggtgcagcgcaagtacatgatctacaactactgcaccgatcccaagcgctaccagcagggcctccccgccgagtgctccatgcagtagcgcccggttattcctcgcccgtccaacaatggcgcgcgcgcgcgtgtgtgtgcatgtggtccgctctactgctaccgctacgacgatcggtgtcgatcaccggatcaaggcaagacgaaaggcatcgaaacatggtagataaataaaggacttgacgatttgtaacgcagtagctggtgcgtgcgtggtgtggtggtaagaaattcttctgctgcctgtgttcttgtagcctcctcgtcctcgcccaccctgttggtacgtgtacggtgtacgtagtctgccgccgcgcgctgttcgtgttcgtcgtgtctcgtgtctgtattatactcgtcctccccatcaaaaaaaaagttgttccatgc

SEQ ID NO: 684 - protein, 298 aa, Zea mays
  REGION 1..298: note = Ceres Clone ID no. 247073
  REGION 28..209: note = Pfam Name: Glyco_hydro_16 Pfam Description: Glycosyl hydrolases family 16
  REGION 247..295: note = Pfam Name: XET_C Pfam Description: Xyloglucan endo-transglycosylase (XET)
  REGION 1..298: note = Bit score of 626.8 for HMM based on sequences of Figure 11
  REGION 1..298: note = Functional Homolog Of SEQ ID NO. 641
  VARIANT 250: note = X can be any amino acid
MATSSRRVPLLLLCLGVLVSCSFAAGSLDQELDITWGDGRGKVLDNGRLLTLSLDRTSGSGFQSRHEYLFGKIDMQLRLVPGNSAGTFTAYYLSSQGGAHDEIDFEFLGNVSGEPYTLHTNVFTRGQGQREQQFRLWFDPTADFHTYSILWNPKHVIFMVDDMPIRDFRNLESKGVAFPKSQPMRLYSSLWNADDWATQGGRVKTDWSHAPFSASYRGFKADACVAVAGGRTRCGATVGTEGTGAPASAXGAGDWYNQELDLTLQQRMRWVQRKYMIYNYCTDPKRYQQGLPAECSMQ

SEQ ID NO: 685 - DNA, 1207 bp, Triticum aestivum
  misc_feature 1..1207: note = Ceres Clone ID no. 1020658
  misc_feature 1..1207: note = Encodes the peptide sequence at SEQ ID NO. 686
  source 1..1207: mol_type = other DNA
acacaaacacaagcttccatcgggctttctcctcctcatcaaccttcttctactactagttgttcctagctagctggttgagtgagcttgctttcgggagcaagaaacgcatggcggtgtcctcggtgctggcgatcctgctcgacgcctcgtgtgcccttgcgtcggcgaccttcgacaaggagttcgacatcacctggggtgacggccgagggaagatcatgaacaatggccagctcctcacgctggggctggacaaggtctccggctccggattccagtccaagcacgagtacctctacggcaagatcgacatgcagctcaagctcgtccccggcaactccgccggcaccgtcaccgcatactacctgtcgtcgcaggggccgacgcacgacgagatcgactttgagttcctgggcaatgtcaccggcgagccgtacactctgcacaccaacgtgttcacgcaggggcaggggcagcgggagcagcagttccgcctctggttcgatcccaccaacgacttccacacctactccatcctctggaacccaaagcacatcatcttcatggtggacgacatgccgatcagggacttcaggaacctggagggaaaggggatcgccttccccaagaaccagccgatgcgcctctactccagcctctggaacgccgacgactgggccacgcaaggaggccgcgtcaagacggactggtcccacgcgccgttctctgcctcctaccgcggcttcaaggccgacgcgtgcgtggtgaccgcggccggccggccgcgctgcggcgccagcgtgggcacggaggtcgcccccggcacgggcgcggcgggcgagtggtacaaccaggagctcgacctgacgcggcagcagcggatgcggtgggtgcagagcaactacatgatctacaactactgcaccgaccccaagcgcttcgcccagggcgttcccgccgagtgctccatgtagtccatgcctgtcgatcgccggagaaagacggccggagatagggaagatggggtgtctgtataatccgatatcaataaggattggtgactgggagatgtgtaaagtagccggtggtagattcttctttggcatttacgcccagttcttctaatcgtgatcacgatcatttcgtgtgtaatctattgcctcgtcgtacatacgttcatcacctgtatgctgctctcggctct

SEQ ID NO: 686 - protein, 288 aa, Triticum aestivum
  REGION 1..288: note = Ceres Clone ID no. 1020658
  REGION 22..203: note = Pfam Name: Glyco_hydro_16 Pfam Description: Glycosyl hydrolases family 16
  REGION 228..286: note = Pfam Name: XET_C Pfam Description: Xyloglucan endo-transglycosylase (XET)
  REGION 1..288: note = Bit score of 638.2 for HMM based on sequences of Figure 11
  REGION 1..288: note = Functional Homolog Of SEQ ID NO. 641
MAVSSVLAILLDASCALASATFDKEFDITWGDGRGKIMNNGQLLTLGLDKVSGSGFQSKHEYLYGKIDMQLKLVPGNSAGTVTAYYLSSQGPTHDEIDFEFLGNVTGEPYTLHTNVFTQGQGQREQQFRLWFDPTNDFHTYSILWNPKHIIFMVDDMPIRDFRNLEGKGIAFPKNQPMRLYSSLWNADDWATQGGRVKTDWSHAPFSASYRGFKADACVVTAAGRPRCGASVGTEVAPGTGAAGEWYNQELDLTRQQRMRWVQSNYMIYNYCTDPKRFAQGVPAECSM

SEQ ID NO: 687 - protein, 292 aa, Hordeum vulgare
  REGION 1..292: note = Public GI ID no. 1890575
  REGION 23..204: note = Pfam Name: Glyco_hydro_16 Pfam Description: Glycosyl hydrolases family 16
  REGION 229..290: note = Pfam Name: XET_C Pfam Description: Xyloglucan endo-transglycosylase (XET)
  REGION 1..292: note = Bit score of 638.0 for HMM based on sequences of Figure 11
  REGION 1..292: note = Functional Homolog Of SEQ ID NO. 641
MARMGASVLSILLASCALAAASFDKEFDVTWGDGRGKILNNGQLLTLGLDKVSGSGFQSKHEYLFGKIDMQLKLVPGNSAGTVTAYYLSSQGPTHDEIDFEFLGNVTGEPYTLHTNVFTQGQGQREQQFRLWFDPTNDFHTYSILWNPKHIIFMVDDMPIRDFKNLEGKGIAFPKNQPMRLYSSLWNADDWATQGARVKTDWSHAPFSASYRGFKADACVVTAGGRPRCGASMGTEAAPGTGASGAAGEWYNQELDLTLQQRMRWVQSNYMIYNYCTDPKRVAKGVPAECSM

SEQ ID NO: 688 - protein, 296 aa, Vitis vinifera
  REGION 1..296: note = Public GI ID no. 225446111
  REGION 31..212: note = Pfam Name: Glyco_hydro_16 Pfam Description: Glycosyl hydrolases family 16
  REGION 236..290: note = Pfam Name: XET_C Pfam Description: Xyloglucan endo-transglycosylase (XET)
  REGION 1..296: note = Bit score of 678.9 for HMM based on sequences of Figure 11
  REGION 1..296: note = Functional Homolog Of SEQ ID NO. 641
MASPSTSNLSPKLLLLSLLFGSFVVASVGNLYQDLDITWGDGRAKILDNGQLLTLSLDKASGSGFQSQDEYLFGKIDMQLKLVPGNSAGTVTAYYLSSQGPTHDEIDFEFLGNLSGDPYILHTNVFSQGKGNREQQFYLWFDPTADFHTYSVLWNPQRIIFSVDGTPIREFKNSESIGVPYPKNQPMRIYSSLWNADDWATRGGLVKTDWSLAPFTASYRNFNANACVWSSGSSSCSSNSPSSTSTNGGWYSQELDSTSQERMKWVQKNYMIYNYCTDTKRFPQGLPLECTATTTS

SEQ ID NO: 689 - protein, 296 aa, Vitis vinifera
  REGION 1..296: note = Public GI ID no. 225446115
  REGION 31..212: note = Pfam Name: Glyco_hydro_16 Pfam Description: Glycosyl hydrolases family 16
  REGION 236..290: note = Pfam Name: XET_C Pfam Description: Xyloglucan endo-transglycosylase (XET)
  REGION 1..296: note = Bit score of 686.6 for HMM based on sequences of Figure 11
  REGION 1..296: note = Functional Homolog Of SEQ ID NO. 641
MASPSTSNLSPKLLLMSLLLGSFVVASVGNLYQDFDLTWGDGRAKILNNGQLLTLSLDKASGSGFQSKNEYLFGKIDMQLKLVPGNSAGTVTAYYLSSQGPTHDEIDFEFLGNLSGDPYILHTNVFSQGKGNREQQFYLWFDPTADFHTYSILWNPQRIIFSVDGTPIREFKNSESIGVPFPKNQPMRIYSSLWNADDWATRGGLVKTDWSQAPFTASYRNFNANACVWSSGSSSCSSTSPSSTSTNSGWYSQELDSTSQERMKWVQKNYMIYNYCTDTKRFPQGLSPECTATTTS

SEQ ID NO: 690 - protein, 287 aa, Vitis vinifera
  REGION 1..287: note = Public GI ID no. 147854714
  REGION 22..203: note = Pfam Name: Glyco_hydro_16 Pfam Description: Glycosyl hydrolases family 16
  REGION 227..281: note = Pfam Name: XET_C Pfam Description: Xyloglucan endo-transglycosylase (XET)
  REGION 1..287: note = Bit score of 686.5 for HMM based on sequences of Figure 11
  REGION 1..287: note = Functional Homolog Of SEQ ID NO. 641
  VARIANT 23: note = X can be any amino acid
  VARIANT 27: note = X can be any amino acid
  VARIANT 283: note = X can be any amino acid
MDVLFLVSLLLGSFVVASVGNLXQDFXITWGDGRAKILNNGELLTLSLDKTSGSGFQSKNEYLFGKIDMQLKLVPGNSAGTVTAYYLSSQGPTHDEIDFEFLGNLSGDPYILHTNVFSQGKGNREQQFYLWFDPTADFHTYSILWNPQRIIFSVDGTPIREFKNSESIGVSYPKNQPMRIYSSLWNADDWATRGGLVKTDWSQAPFTASYRNFNADACIWSSGASSCSSNTPTSTSTNTEWYSQELDSTSQERMKWVQKNYMIYNYCSDTKRFPQGLPPECTXTTMS

SEQ ID NO: 691 - protein, 304 aa, Sagittaria pygmaea
  REGION 1..304: note = Public GI ID no. 68532877
  REGION 41..222: note = Pfam Name: Glyco_hydro_16 Pfam Description: Glycosyl hydrolases family 16
  REGION 248..301: note = Pfam Name: XET_C Pfam Description: Xyloglucan endo-transglycosylase (XET)
  REGION 1..304: note = Bit score of 627.1 for HMM based on sequences of Figure 11
  REGION 1..304: note = Functional Homolog Of SEQ ID NO. 641
MALRPSLHKQFALLVAASVLAFCCSAAGRSVGLAPASPSSFNNDFDITWGDGRGKILNNGQLLSLSLDKTSGSGFQSKNQYLFGNIDMQLKLVPGNSAGTVTAYYLSSQGPTHDEIDFEFLGNVSGQPYTLHTNVFSQGKGNREQQFRLWFDPTKDFHTYSILWNPSHIVFYVDGTPIRDFRNNEARGVPFPKAQPMRIYSSLWNADDWATQGGRIKTDWTQAPFTASYRGFKADACAVGSTGSSSKCAALQTTAGNTNWWIRQELDATGQERMRWVQRNHMIYNYCTDVNRFPQGLPTECSVA

SEQ ID NO: 692 - protein, 295 aa, Vitis vinifera
  REGION 1..295: note = Public GI ID no. 147779866
  REGION 31..212: note = Pfam Name: Glyco_hydro_16 Pfam Description: Glycosyl hydrolases family 16
  REGION 236..290: note = Pfam Name: XET_C Pfam Description: Xyloglucan endo-transglycosylase (XET)
  REGION 1..295: note = Bit score of 682.1 for HMM based on sequences of Figure 11
  REGION 1..295: note = Functional Homolog Of SEQ ID NO. 641
  VARIANT 211: note = X can be any amino acid
MASPSTSNLSPKLLLVSVLFGSLVIASVGNLHKDFDITWGDGRAKILDNGQLLTLSLDKTSGSGFQSKNEYMFGKIDMQLKLVPGNSAGTVTAYYLSSQGPTHDEIDFEFLGNLSGDPYILHTNVFSQGKGNREQQFYLWFDPTADFHSYSILWNPQRIIFSVDGTPIREFKNSESIGVPYPKNQPMRIYSSLWNADDWATRGGLVKTDWXQAPFTASYRNFNADACIWSSGASSCSSTTPSSTSTSGQWYSQELDSTSQERMKWVQKNYMIYNYCTDTKRFPQGLPPECRHHIL

SEQ ID NO: 693 - DNA, 1057 bp, Gossypium hirsutum
  misc_feature 1..1057: note = Ceres Clone ID no. 100062911
  misc_feature 1..1057: note = Encodes the peptide sequence at SEQ ID NO. 694
  source 1..1057: mol_type = other DNA
cataaatcctctgctctgcaaaaaaaatcgaaagtcaaaaatgagttcttcaggtttcaaatttaccttgcttgttccgcttatggttgcttgtctcatggcatcatcagccagcaatttccacaatgattttgacataacatggggagacggccgtggtaaaatcgtcaacaatggagaggttctcactctctcccttgataaagcttctggttctggtttccaatccaagaacgagtacctattcggcaagattgatatgcagctcaagcttgtccctggaaactccgctggcacagtcactgcttactatctatcttcgaaaggatcaacatgggatgaaattgatttcgagttccttgggaatttaagtggtgacccttacattcttcacacaaatgtgttcagtcaaggaaagggtaacagagaacaacaattctacctctggtttgacccaactgtagatttccatacttattcaatcctttggaatccccaacgtataatcttctctgttgacggtacacccattagagagttcaaaaacatggaatcatttggtgtcccgtttcctaagaaccagccgatgagaatttactctagcttgtggaatgctgatgattgggccacaaggggtggtttggttaagaccgactggactcaagctcctttcactgcctcttacaggaacttcaatgccgatgcttgtgtgtggaccaatggggcttcttcgtgtaaatcgaatgcttcaccatcttctgcatcgacaaacagtgcatggttctctcaagaaatggattcagctaagcaacaaaggttgaaatgggtgcaaaagaactacatgatatacaactactgcaatgatgctaagagatttcctcaaggtctacctccagagtgcaatatgtcttaaaaaacttgacaagcctattagatcaaattgttttagagattaatattcaattatattcttttattatttgttctttattcaaaaccaggtcataagtcttttatcttttgaaatttcccatcaaaaaaaagttaaggcggccgc

SEQ ID NO: 694 - protein, 290 aa, Gossypium hirsutum
  REGION 1..290: note = Ceres Clone ID no. 100062911
  REGION 27..208: note = Pfam Name: Glyco_hydro_16 Pfam Description: Glycosyl hydrolases family 16
  REGION 232..287: note = Pfam Name: XET_C Pfam Description: Xyloglucan endo-transglycosylase (XET)
  REGION 1..290: note = Bit score of 662.6 for HMM based on sequences of Figure 11
  REGION 1..290: note = Functional Homolog Of SEQ ID NO. 641
MSSSGFKFTLLVPLMVACLMASSASNFHNDFDITWGDGRGKIVNNGEVLTLSLDKASGSGFQSKNEYLFGKIDMQLKLVPGNSAGTVTAYYLSSKGSTWDEIDFEFLGNLSGDPYILHTNVFSQGKGNREQQFYLWFDPTVDFHTYSILWNPQRIIFSVDGTPIREFKNMESFGVPFPKNQPMRIYSSLWNADDWATRGGLVKTDWTQAPFTASYRNFNADACVWTNGASSCKSNASPSSASTNSAWFSQEMDSAKQQRLKWVQKNYMIYNYCNDAKRFPQGLPPECNMS

SEQ ID NO: 695 - protein, 296 aa, Vitis vinifera
  REGION 1..296: note = Public GI ID no. 225446117
  REGION 31..212: note = Pfam Name: Glyco_hydro_16 Pfam Description: Glycosyl hydrolases family 16
  REGION 236..290: note = Pfam Name: XET_C Pfam Description: Xyloglucan endo-transglycosylase (XET)
  REGION 1..296: note = Bit score of 683.1 for HMM based on sequences of Figure 11
  REGION 1..296: note = Functional Homolog Of SEQ ID NO. 641
MTYPTTSNLSPKLLLLSLLLGSFVVASVGNLYQDFDITWGDGRAKILNNGQLLTLSLDKASGSGFRSNNEYLFGKIDMQLKLVPGNSAGTVTAYYLSSQGPTHDEIDFEFLGNLSGDPYILHTNVFSQGKGNREQQFYLWFDPTADFHTYSVLWNPQRIIFSVDGTPIREFKNSESIGVPYPKNQPMRIYSSLWNADDWATRGGLVKTDWSQAPFTASYRNFNANACVWSSGSSSCSSTSPSSTSTNGGWYSQELDSTSQERMTWVQKNYMIYNYCTDTKRFPQGLPPECTATTMS

SEQ ID NO: 696 - DNA, 1037 bp, Gossypium hirsutum
  misc_feature 1..1037: note = Ceres Clone ID no. 1832719
  misc_feature 1..1037: note = Encodes the peptide sequence at SEQ ID NO. 697
  source 1..1037: mol_type = other DNA
ataatatcataatccaattagaatagaaacaccatacagacaaataaaatatgaagagttcattgctagtatctgttgtaatcagcttggtaatagttgcttcagccgccaactttaaccaagacatcgacgttacttggggagatgggaggggcaagattctcgaaaacggaaaccttctcactctcaccctcgacaaattctccgggtctggttttcaatccaagaaccaatatctgtttgggaagatcgatatgaacattaagctggttccaggcaactctgctggcactgttaccacttactatcttcgttcggaagggtcgacatgggatgaaattgacttcgaattcttggggaacctaagcggagacccatacatagtccacaccaatgtatatacacaaggcaaaggtgacaaagaacagcagttctacctttggttcgatcctaccaaagacttccatacctactcccttctttggaaccctcaacgtattatcttctctgttgatgggacaccaattagagagttcaagaacttggaatcaaagggcgttgcgttcccaaagagccagccgatgagagtgtattcgagtctttggaacgccgatgattgggccactcgaggtggccttgttaagacggattggagccaagctccattcactgcttcttacaggactttcaaagctgatgcatgtgtctggtcttccggtaaatcatcatgttcctccacctcaccctcccaaaattcatggctgtcgcaagaactggatataacgagccaacaaaggctcaaatgggttcagaaaaattatatgatttacaattactgcaccgacaccaagcgatttgctatgggacttcctaaagagtgcactgcttcttaatttgttgattaaaacttccttcgctagtcatgcctaaggacagatactttgttcaaaagcagcctctcacagtattcttttgtttcattctatgttttgtaacatgtaaaactaagctcaataaataatactattcaatttcgg

SEQ ID NO: 697 - protein, 280 aa, Gossypium hirsutum
  REGION 1..280: note = Ceres Clone ID no. 1832719
  REGION 22..203: note = Pfam Name: Glyco_hydro_16 Pfam Description: Glycosyl hydrolases family 16
  REGION 227..277: note = Pfam Name: XET_C Pfam Description: Xyloglucan endo-transglycosylase (XET)
  REGION 1..280: note = Bit score of 651.7 for HMM based on sequences of Figure 11
  REGION 1..280: note = Functional Homolog Of SEQ ID NO. 641
MKSSLLVSVVISLVIVASAANFNQDIDVTWGDGRGKILENGNLLTLTLDKFSGSGFQSKNQYLFGKIDMNIKLVPGNSAGTVTTYYLRSEGSTWDEIDFEFLGNLSGDPYIVHTNVYTQGKGDKEQQFYLWFDPTKDFHTYSLLWNPQRIIFSVDGTPIREFKNLESKGVAFPKSQPMRVYSSLWNADDWATRGGLVKTDWSQAPFTASYRTFKADACVWSSGKSSCSSTSPSQNSWLSQELDITSQQRLKWVQKNYMIYNYCTDTKRFAMGLPKECTAS

SEQ ID NO: 698 - DNA, 987 bp, Gossypium hirsutum
  misc_feature 1..987: note = Ceres Clone ID no. 1793297
  misc_feature 1..987: note = Encodes the peptide sequence at SEQ ID NO. 699
  source 1..987: mol_type = other DNA
aacatcctaatacaaacctaccaaaaaaaatgaggacttccttgctgctactatctgccttaatcagctttgtaatggttgcttccgccgccaactttaaccaagacatccacgttacttggggagatgggaggggcaagattctcgaaaacggaaaccttctccctctcaccctcgacaaattctccggctctggttttcaatccaagaaccaatatctgtttgggaagattgatatgaacattaagctggtcccaagcaactctgctggcactgttaccacttactatcttcgttcggaagggtcgacatgggatgaaatcgacttcgagttcttggggaacctaagcggagacccatacatagtccacaccaatgtatatacacaaggcaaaggtgacaaagagcaacagttctacctttggttcgatcccaccaaagacttccacacctactcccttctttggaaccctcaacgtattatcttctctgttgatgggactccgctcagagagttcaagaacttggaatcgaagggcgttgcgttcccaaagagccagccgatgagagtgtattcgagtctttggaacgccgatgattgggccactcgaggtggtcttgttaagacagattggagccaagctcctttcactgctgcttacaggaattacaaggctgatacatgtgtgtggtcttccgggaaatcatcatgttcctccacctcgccctctcaaaattcatggctatcgcaagaactggatataacgagccaagaaaggctgaaatgggttcagaaaaattacatgatttacaattactgcactgataccaagcgattccctcagggacttcctaaagaatgcactgctccttaacagggattttaatttaattaatttcctcaatagtattcttttgtttcattatacatatattgtaacatgtaatataagctcaataataatattctatttcgaatattaaacg

SEQ ID NO: 699 - protein, 281 aa, Gossypium hirsutum
  REGION 1..281: note = Ceres Clone ID no. 1793297
  REGION 23..204: note = Pfam Name: Glyco_hydro_16 Pfam Description: Glycosyl hydrolases family 16
  REGION 228..278: note = Pfam Name: XET_C Pfam Description: Xyloglucan endo-transglycosylase (XET)
  REGION 1..281: note = Bit score of 644.1 for HMM based on sequences of Figure 11
  REGION 1..281: note = Functional Homolog Of SEQ ID NO. 641
MRTSLLLLSALISFVMVASAANFNQDIHVTWGDGRGKILENGNLLPLTLDKFSGSGFQSKNQYLFGKIDMNIKLVPSNSAGTVTTYYLRSEGSTWDEIDFEFLGNLSGDPYIVHTNVYTQGKGDKEQQFYLWFDPTKDFHTYSLLWNPQRIIFSVDGTPLREFKNLESKGVAFPKSQPMRVYSSLWNADDWATRGGLVKTDWSQAPFTAAYRNYKADTCVWSSGKSSCSSTSPSQNSWLSQELDITSQERLKWVQKNYMIYNYCTDTKRFPQGLPKECTAP

SEQ ID NO: 700 - DNA, 1190 bp, Gossypium hirsutum
  misc_feature 1..1190: note = Ceres Clone ID no. 1848637
  misc_feature 1..1190: note = Encodes the peptide sequence at SEQ ID NO. 701
  source 1..1190: mol_type = other DNA
aaaaacccctctcttcttctctctttttctcattcattctttagtttcaatatcaaagcaaaaatgggttcttcttgtaatgttgtttcaatggccttactggcttgtttggtgttgaactccttggtttttgttgcccacggtggtgacttttaccaggatttcgacctaacatggggtgacagaagaggcaagattttcaatggtggcaagctcttgtctttgtctttagacagggtttcagggtctggttttcaatctaagaaagagtatttgtttggaaggatcgatatgcaactcaagcttgttgctggcaactcagctggcactgtcactgcttattatctgtcatctcaagggccaacccatgatgagatagactttgaattcttagggaatctgagcggtgacccttacattttacacaccaatgtctttacacaaggcaaaggcaacagagaacaacagttctatctttggtttgaccctacaagaaacttccacacctattccatcatttggaaaccccaacacatcattttcttggtggataacacccccattagagtcttcaaaaatgctgaatccattggtgtaccattccccaagagccaacccatgaggatttactctagtttatggaatgctgatgattgggccacaaggggtggattagtgaaaactgattgggcaaaagcacctttcacagcttattacaggaacttcaatgccaatgcttgtgtctggtcaggaacaagttcatcatgtgctaaaactaactcggtctccgccggtgcatgggaaacaaacgaacttgatgcaccaggaagaagaagattaagatgggttcaaaaatatttcatgatttataactattgcactgatttgaaacgtttccctcaaggtgttccaccagagtgtaaacgcccaaggttctaaaatcaaacctgttccaccagagtgtaaacgcccagggttctaaaatcaaacctctcctcttttccatgtaatatattctttttttcactactttcttactatgtattcaagttgaataagttattattattattattattctttttatgtatttttatttctctttgttgcttcttaaatcatcttgaaaatagatgtaaattccctgtttctgataataaaattttcctctttttgagtatttaatattc

SEQ ID NO: 701 - protein, 291 aa, Gossypium hirsutum
  REGION 1..291: note = Ceres Clone ID no. 1848637
  REGION 30..211: note = Pfam Name: Glyco_hydro_16 Pfam Description: Glycosyl hydrolases family 16
  REGION 235..286: note = Pfam Name: XET_C Pfam Description: Xyloglucan endo-transglycosylase (XET)
  REGION 1..291: note = Bit score of 628.7 for HMM based on sequences of Figure 11
  REGION 1..291: note = Functional Homolog Of SEQ ID NO. 641
MGSSCNVVSMALLACLVLNSLVFVAHGGDFYQDFDLTWGDRRGKIFNGGKLLSLSLDRVSGSGFQSKKEYLFGRIDMQLKLVAGNSAGTVTAYYLSSQGPTHDEIDFEFLGNLSGDPYILHTNVFTQGKGNREQQFYLWFDPTRNFHTYSIIWKPQHIIFLVDNTPIRVFKNAESIGVPFPKSQPMRIYSSLWNADDWATRGGLVKTDWAKAPFTAYYRNFNANACVWSGTSSSCAKTNSVSAGAWETNELDAPGRRRLRWVQKYFMIYNYCTDLKRFPQGVPPECKRPRF

SEQ ID NO: 702 - protein, 285 aa, Vitis vinifera
  REGION 1..285: note = Public GI ID no. 225446103
  REGION 22..203: note = Pfam Name: Glyco_hydro_16 Pfam Description: Glycosyl hydrolases family 16
  REGION 227..279: note = Pfam Name: XET_C Pfam Description: Xyloglucan endo-transglycosylase (XET)
  REGION 1..285: note = Bit score of 677.4 for HMM based on sequences of Figure 11
  REGION 1..285: note = Functional Homolog Of SEQ ID NO. 641
MASSSILVLMLSMLVVASGGNFNQDFDITWGDGRAKILNNGQLLTLSLDKASGSGFQSRNEYLFGKIDMQLKLVSGNSAGTVTAYYLSSQGSAHDEIDFEFLGNLSGDPYILHTNVFSQGKGNREQQFYLWFDPTADFHTYSILWNPQLIIFSVDGTPIRQFKNLESKGVAYPKNQPMRIYSSLWNADDWATRGGLVKTDWSQAPFTASYRNFNANACVWSSGSSSCSKNSSSTTSNAWLYQELDSSSQEKLKWVQKNYMIYNYCTDTKRFPQGLPPECTATNNS

SEQ ID NO: 703 - DNA, 1067 bp, Arabidopsis thaliana
  misc_feature 1..1067: note = Ceres Annot ID no. 1362908
  misc_feature 1..1067: note = Encodes the peptide sequence at SEQ ID NO. 704
  source 1..1067: mol_type = other DNA
acaaaccaatctaactcaatacaagaatatctacaatctctagaaaatggcgatcacttacttgcttcctctgtttctttctcttatcatcacctcctctgtttcagctaatttccaaagagacgttgagatcacttggggtgatggtcgtggacagatcaagaacaatggagagcttctcactttatctctagataaatcctctggttctggattccaatccaaaaacgagtacttgtttggtaaagtctccatgcaaatgaagcttgtccctggaaactccgcaggaacagtcacaacactttacttgaaatcacctggaacaacatgggacgagatagatttcgagtttttagggaattcaagtggagaaccttacacacttcacacaaatgtctacacacaaggcaaaggagacaaagaacaacaattcaaactctggtttgatccaacagctaatttccacacttacactattctctggaacccacaaagaatcattttcaccgtcgatggaactccgatcagagaattcaagaacatggagtctctaggcactctgtttcccaagaacaaaccaatgagaatgtactcgagtctttggaacgctgatgattgggcaacgagaggtggtttggtcaaaaccgattggtctaaagctcctttcactgcttcttaccgtggctttcaacaagaagcttgtgtttggtcaaacggcaagtcttcttgtcctaatgcctcgaaacaggggactactactggctcgtggttgtcacaagagcttgactcaacagctcaacaaaggatgagatgggtgcagaggaactacatgatctataattattgtacggatgcgaagaggttccctcaaggtcttcctaaagagtgcttagctgcatagagagagtaaagagttgagagaggaacaagattttatttttctttgtggttataaaattctattcattttattgtagatcacgtgaattttattgatttgttttgtagtatactctatagttcgttaaagttataatattctctttgttacaatgtgcttttttgtt

SEQ ID NO: 704 - protein, 284 aa, Arabidopsis thaliana
  REGION 1..284: note = Ceres Annot ID no. 1362908
  REGION 23..204: note = Pfam Name: Glyco_hydro_16 Pfam Description: Glycosyl hydrolases family 16
  REGION 228..281: note = Pfam Name: XET_C Pfam Description: Xyloglucan endo-transglycosylase (XET)
  REGION 1..284: note = Bit score of 623.8 for HMM based on sequences of Figure 11
  REGION 1..284: note = Functional Homolog Of SEQ ID NO. 641
MAITYLLPLFLSLIITSSVSANFQRDVEITWGDGRGQIKNNGELLTLSLDKSSGSGFQSKNEYLFGKVSMQMKLVPGNSAGTVTTLYLKSPGTTWDEIDFEFLGNSSGEPYTLHTNVYTQGKGDKEQQFKLWFDPTANFHTYTILWNPQRIIFTVDGTPIREFKNMESLGTLFPKNKPMRMYSSLWNADDWATRGGLVKTDWSKAPFTASYRGFQQEACVWSNGKSSCPNASKQGTTTGSWLSQELDSTAQQRMRWVQRNYMIYNYCTDAKRFPQGLPKECLAA

SEQ ID NO: 705 - DNA, 1052 bp, Gossypium hirsutum
  misc_feature 1..1052: note = Ceres Clone ID no. 100064069
  misc_feature 1..1052: note = Encodes the peptide sequence at SEQ ID NO. 706
  source 1..1052: mol_type = other DNA
ataatctgaactacaatacaagcccaccaaaataatgaccacttcgttgcttctatctcttttattcagctttgtagtacttgcctcagctgccaactttaaccaagacatcgatgttacttggggtgatggcaggggcaagattctcgaaaacggaaaccttctcactctcaccctcgacaaattctccggctctggttttcaatccaagaaccaatatctgtttgggaagatcgatatgaacattaaactggtcccaggcaactctgctggcactgttaccacttactatcttcgttcggaagggtcgacatgggatgaaatcgacttcgagttcttggggaacctaagcggagacccatacatagtccacaccaatgtatatacacaaggcaaaggtgacaaagagcaacagttctacctctggttcgatcccaccaaagacttccacacctactcccttctttggaaccctcaacgtattatcttctctgttgatgggactccgctcagagagttcaagaacttggaatcgatgggcgttgcgttcccaaagagccagccgatgagagtgtattcgagtctttggaacgctgatgattgggccactcgaggtggtcttgttaagacagattggagccaagctcctttcactgctgcttacaggaattacaaggctgatgcatgtgtctggtcctccgggaaatcatcatgttcctccacctcgccctctcaaaattcatggctatcgcaagaactggatataacgagccaacaaagactaaaatgggttcagaaaaattacatgatctacaattactgcactgacaccaagcgattccctcagggacttcccaaagaatgcagtgttcattaacagggattctaaatttgttatagtagagattttattggttaaatttgtgaatgttctttaaatctttgttcactagtgagtaatatacttaaagacagatattgtgtgtatttgttctatgttcagtaacgtgtaatctaagttcaataataaatgttattatagtactttcggc

SEQ ID NO: 706 - protein, 280 aa, Gossypium hirsutum
  REGION 1..280: note = Ceres Clone ID no. 100064069
  REGION 22..203: note = Pfam Name: Glyco_hydro_16 Pfam Description: Glycosyl hydrolases family 16
  REGION 227..277: note = Pfam Name: XET_C Pfam Description: Xyloglucan endo-transglycosylase (XET)
  REGION 1..280: note = Bit score of 647.5 for HMM based on sequences of Figure 11
  REGION 1..280: note = Functional Homolog Of SEQ ID NO. 641
MTTSLLLSLLFSFVVLASAANFNQDIDVTWGDGRGKILENGNLLTLTLDKFSGSGFQSKNQYLFGKIDMNIKLVPGNSAGTVTTYYLRSEGSTWDEIDFEFLGNLSGDPYIVHTNVYTQGKGDKEQQFYLWFDPTKDFHTYSLLWNPQRIIFSVDGTPLREFKNLESMGVAFPKSQPMRVYSSLWNADDWATRGGLVKTDWSQAPFTAAYRNYKADACVWSSGKSSCSSTSPSQNSWLSQELDITSQQRLKWVQKNYMIYNYCTDTKRFPQGLPKECSVH

SEQ ID NO: 707 - DNA, 1170 bp, Populus balsamifera
  misc_feature 1..1170: note = Ceres Annot ID no. 1469128
  misc_feature 1..1170: note = Encodes the peptide sequence at SEQ ID NO. 708
  source 1..1170: mol_type = other DNA
atgagaatgtccaactgcttaatcctttcaattaaaaagaaatatgggttcactgggaaagcaggaggcatacccctttcaaaggcagatattgctgctggtgttgctgattccttagccatcatatactttaattgttttttccagcgaaggccatgtttcgcggcagttctttggtttgcacatcaaattgtgcagaatgaatcaagaagagcatcagcactgaggaaaacaggaaagaatggccaaggacataagccattaacagctttgatgctaacgactccatacacaatccttaccaccaccgactcaatggtgacggtagtgggtttagtcagttctttgatggggtcatctcttggtaacttctaccaaaactttgatattacatggggagatggccgtgctaagatactcaacaatggtgagcttcttactctcaatcttgacaaagcttctggctcaggattccaatccaagaacgagtatttatttggaaagattgatatgcaactcaagcttgtccctggcaactccgctggcactgtaactgcctattatttgtcatcaaaagggtcaacatgggatgagatagacttcgagttcttggggaacttgagtggcgatccttacattctccataccaatgtgtttagccaaggcaaaggcaacagggagcaacaattttacctctggtttgatccaactactgatttccacacctactccatcctctggaacccacaaagaatcattttctctgtagatggcacccctattagagaattcaagaacatggaatcaagaggtgttccattcccaaagaatcagccaatgagaatttactctagtttatggaatgcagatgactgggctacaagaggtggcttagtgaagactgattggtcaaaagctcctttcactgcttcttataagaacttcaatgctaaggatgcttgtgtctggtccaatggtgcatcttcttgtggtacaaattcctctgctgctgcagcctcctccaccaccaacgcttggctttcagaagagcttggttcaacaagtcaagagaggctagaatgggtcaaaaaaaactacatgatatacaattactgcacagacgctaagaggtttcctcaaggacttcctccagaatgcagcgcttcttaa

SEQ ID NO: 708 - protein, 298 aa, Populus trichocarpa
  REGION 1..298: note = Ceres Annot ID no. 1469128
  REGION 33..214: note = Pfam Name: Glyco_hydro_16 Pfam Description: Glycosyl hydrolases family 16
  REGION 239..295: note = Pfam Name: XET_C Pfam Description: Xyloglucan endo-transglycosylase (XET)
  REGION 1..298: note = Bit score of 657.2 for HMM based on sequences of Figure 11
  REGION 1..298: note = Functional Homolog Of SEQ ID NO. 641
MLTTPYTILTTTDSMVTVVGLVSSLMGSSLGNFYQNFDITWGDGRAKILNNGELLTLNLDKASGSGFQSKNEYLFGKIDMQLKLVPGNSAGTVTAYYLSSKGSTWDEIDFEFLGNLSGDPYILHTNVFSQGKGNREQQFYLWFDPTTDFHTYSILWNPQRIIFSVDGTPIREFKNMESRGVPFPKNQPMRIYSSLWNADDWATRGGLVKTDWSKAPFTASYKNFNAKDACVWSNGASSCGTNSSAAAASSTTNAWLSEELGSTSQERLEWVKKNYMIYNYCTDAKRFPQGLPPECSAS

SEQ ID NO: 709 - DNA, 1116 bp, Glycine max
  misc_feature 1..1116: note = Ceres Clone ID no. 656868
  misc_feature 1..1116: note = Encodes the peptide sequence at SEQ ID NO. 710
  source 1..1116: mol_type = other DNA
atgacattatccattcactaatcactaccaattgctaaagatatttcactcactggtcacactactaatacagctttctggagatggcttcaactgtctcttacatgcttctacttccccttctagtgatggttgcctttgctggggacttaaacaaagactttgacatcacatggggagatggccgctccaagatactaaaccatggagagttactcactctttcattggacaaagcatctggctcaggttttcaatcaaagaatgagtatctctttgggaagattgacatgcagctcaagcttgtccctggaaactctgctggcaccgtcactacctattatttatcttcaaaaggatcaacttgggatgaaatagactatgaatttcttggaaatctgagtggtgatccatacatccttcacacaaacgttttcagccaaggcaagggggacagggaacaacaattctatctatggtttgacccaactgctgatttccacacttactccatcatgtggaacccccagaggattatattctcagttgatggcactcccattagagagttcaagaactcggaggctattggggttcccttcccaaagaatcagccaatgaggatatattctagtttgtggaatgctgatgactgggcaacaagaggtggacttgtgaagacagattggacacaagctccgttcacagcttcctacagaaacttcaatgctgaggcttgcatatggtcttctggagcatcttcttgcgctaaaacttcttctacacccaccagtggcagtggttcatggctttcacaggaattggacgctacaggccatcagaggttgaagtgggtgcagaagaactacatgatttacaattattgcacagacactaagcgcttcccacagggtcttcctccagaatgcaacatctcttgagagaaaaacattgcaacgcattccttatattttctatgatcagaatgtcataccactaccagtattagttttattgttgtagctactgtagttaaattctttcatttgttcccctgtttggcatcactatgtaaacaaatatggccatttttataataaaataaattcttttgcc

SEQ ID NO: 710 - protein, 285 aa, Glycine max
  REGION 1..285: note = Ceres Clone ID no. 656868
  REGION 23..204: note = Pfam Name: Glyco_hydro_16 Pfam Description: Glycosyl hydrolases family 16
  REGION 228..282: note = Pfam Name: XET_C Pfam Description: Xyloglucan endo-transglycosylase (XET)
  REGION 1..285: note = Bit score of 669.6 for HMM based on sequences of Figure 11
  REGION 1..285: note = Functional Homolog Of SEQ ID NO. 641
MASTVSYMLLLPLLVMVAFAGDLNKDFDITWGDGRSKILNHGELLTLSLDKASGSGFQSKNEYLFGKIDMQLKLVPGNSAGTVTTYYLSSKGSTWDEIDYEFLGNLSGDPYILHTNVFSQGKGDREQQFYLWFDPTADFHTYSIMWNPQRIIFSVDGTPIREFKNSEAIGVPFPKNQPMRIYSSLWNADDWATRGGLVKTDWTQAPFTASYRNFNAEACIWSSGASSCAKTSSTPTSGSGSWLSQELDATGHQRLKWVQKNYMIYNYCTDTKRFPQGLPPECNIS

SEQ ID NO: 711 - DNA, 1094 bp, Gossypium hirsutum
  misc_feature 1..1094: note = Ceres Clone ID no. 1793334
  misc_feature 1..1094: note = Encodes the peptide sequence at SEQ ID NO. 712
  source 1..1094: mol_type = other DNA
atcacctattctctgctgtgccaaaaaacaaaagacaaaatgagttattccagttcctccaagtttcccttgcttatgcctcttatggttgcctgtcttattatggcagcctcaggtagcaacttccacaacgattttgacatcacatggggagatgggcgtggtaagattgttaacaatggcgaggttctcactctctccctcgataaacaatctggttctggtttccaatccaagaatgagtatctttttggcaagattgatatgcagctcaagcttgtccctggaaactctgccggcactgtcactgcatactatttatcatcaaaaggaacaacgtgggatgaaattgatttcgagttccttggaaatctaagtggtgacccttatattctacacacaaatgcgtttagtcaaggaaaaggcaacagagaacaacaattctacctctggtttgacccaactacagatttgcatacttattccatcctatggaatccagaacgcatcatcttctccgtggatgatacacccattagagagttcaaaaacatggagtcgattggtgtcccatttcccaagaaccagcccatgagaatttactccagcttgtggaatgctgatgactgggccacaaggggtggtctggttaagaccgactggacccaagctcctttcactgcctcgtacaggaacttcaatgccgatgcttgtgtgtggtccaatggagcttcttcctgcaaatcaaatgccccatcttcttctacatcaacaaacaatgcatggttctctcaagagatggattcagcaaagcagcaaaggctacaatgggtgcagcagaattacatgatctacaattactgcactgacgccaagagatttcctcaaggtctaccttcagagtgcaagatgtcttaaggactagaacagaaaattagagatggtattatgttagtcttagagatcatcaatattcaatattctttaattttttttttcttttttttttcttaaaaccaagtggtgattctttttcatctttgagaattctcattgctttgtacgtgatacatgattaatttaattcccctttc

SEQ ID NO: 712 - protein, 292 aa, Gossypium hirsutum
  REGION 1..292: note = Ceres Clone ID no. 1793334
  REGION 29..210: note = Pfam Name: Glyco_hydro_16 Pfam Description: Glycosyl hydrolases family 16
  REGION 234..289: note = Pfam Name: XET_C Pfam Description: Xyloglucan endo-transglycosylase (XET)
  REGION 1..292: note = Bit score of 654.0 for HMM based on sequences of Figure 11
  REGION 1..292: note = Functional Homolog Of SEQ ID NO. 641
MSYSSSSKFPLLMPLMVACLIMAASGSNFHNDFDITWGDGRGKIVNNGEVLTLSLDKQSGSGFQSKNEYLFGKIDMQLKLVPGNSAGTVTAYYLSSKGTTWDEIDFEFLGNLSGDPYILHTNAFSQGKGNREQQFYLWFDPTTDLHTYSILWNPERIIFSVDDTPIREFKNMESIGVPFPKNQPMRIYSSLWNADDWATRGGLVKTDWTQAPFTASYRNFNADACVWSNGASSCKSNAPSSSTSTNNAWFSQEMDSAKQQRLQWVQQNYMIYNYCTDAKRFPQGLPSECKMS

SEQ ID NO: 713 - protein, 283 aa, Cucumis sativus
  REGION 1..283: note = Public GI ID no. 29500891
  REGION 24..205: note = Pfam Name: Glyco_hydro_16 Pfam Description: Glycosyl hydrolases family 16
  REGION 229..280: note = Pfam Name: XET_C Pfam Description: Xyloglucan endo-transglycosylase (XET)
  REGION 1..283: note = Bit score of 652.3 for HMM based on sequences of Figure 11
  REGION 1..283: note = Functional Homolog Of SEQ ID NO. 641
MASTTLFLTLLFSASLIAISSANFNQDFQITWGDGRAKILNNGELLTLSLDKASGSGFQSQNEYLFGKIDMQLKLVAGNSAGTVTAYYLSSKGSTWDEIDFEFLGNLSGDPYTLHTNVFSQGKGNREQQFHLWFDPTADFHTYSILWNPNRIIFSVDGTPIREFKNWESNGVPFPKDQPMRIYSSLWNADDWATRGGLVKTDWTKAPFTASYKNFKAEACVWSGGKSSCSPSPAGSSNSWLSQEMDSASQERLKWVQKNYMIYNYCTDTKRFPQGLPTECNLP

SEQ ID NO: 714 - DNA, 1142 bp, Gossypium hirsutum
  misc_feature 1..1142: note = Ceres Clone ID no. 1895226
  misc_feature 1..1142: note = Encodes the peptide sequence at SEQ ID NO. 715
  source 1..1142: mol_type = other DNA
acaaaacccctctcttcttctctcttttactcattcattctttagtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagatagactttgaattcttagggaatctgagtggtgacccttacattttacacaccaatgtcttcacacaaggcaaaggcaacagagaacaacagttttatctttggtttgaccctacaagaaagttccacacctattccatcatttggaaaccccaacacatcattttcttggtggataacatccccattagagtcttcaaaaatgctgaatccattggtgtaccgttccccaagagccaacccatgaggatttactctagtttatggaatgctgatgattgggccacaaggggtgggttagtgaaaactgattgggcaaaagcacctttcacagcttattacaggaacttcattgccaatgcttgtgtctggtcaggaagaagttcatcatgcgctaaaactaactcggtctccgccggtgcatgggaaacaaacgaacttgatgcaccaggaagaagaagattaagatgggttcaaaaatatttcatgatttataactattgtactgatttgaaacgtttccctcaaggtgttccaccagagtgtaaacgcccaaggttctaaaatcaaacctctcctcctttccatgtaatatattctttttttcactactttcttactatgtattcaagttgcactcaacttgatgcttggggatggatggaataagttgctattattattattcttttttttatgtatttttatttcgttttgttgcttcttaaatcatcttgaaaatagatgtaaattccctgtttctgac

SEQ ID NO: 715 - protein, 291 aa, Gossypium hirsutum
  REGION 1..291: note = Ceres Clone ID no. 1895226
  REGION 30..211: note = Pfam Name: Glyco_hydro_16 Pfam Description: Glycosyl hydrolases family 16
  REGION 235..286: note = Pfam Name: XET_C Pfam Description: Xyloglucan endo-transglycosylase (XET)
  REGION 1..291: note = Bit score of 621.2 for HMM based on sequences of Figure 11
  REGION 1..291: note = Functional Homolog Of SEQ ID NO. 641
MASSCNVVSMALLACLVLNSLVFVAHGGDFYQDFDLTWGDKRGKIFNGGKLLSLSLDRVSGSGFKSKKEYLFGRIDMQLKLVAGNSAGTVTAYYLSSQGPTHDEIDFEFLGNLSGDPYILHTNVFTQGKGNREQQFYLWFDPTRKFHTYSIIWKPQHIIFLVDNIPIRVFKNAESIGVPFPKSQPMRIYSSLWNADDWATRGGLVKTDWAKAPFTAYYRNFIANACVWSGRSSSCAKTNSVSAGAWETNELDAPGRRRLRWVQKYFMIYNYCTDLKRFPQGVPPECKRPRF

SEQ ID NO: 716 - protein, 284 aa, Asparagus officinalis
  REGION 1..284: note = Public GI ID no. 8886865
  REGION 29..210: note = Pfam Name: Glyco_hydro_16 Pfam Description: Glycosyl hydrolases family 16
  REGION 234..281: note = Pfam Name: XET_C Pfam Description: Xyloglucan endo-transglycosylase (XET)
  REGION 1..284: note = Bit score of 632.6 for HMM based on sequences of Figure 11
  REGION 1..284: note = Functional Homolog Of SEQ ID NO. 641
MSSSLMSQCVHIFLAATFVAMSGVHGGNFYRDFDLTWGDGRAKILNNGQMLTLSLDKVSGSGFQSKNQYLFGKIDMQLKLVPGNSAGTVTAYYLSSQGPTHDEIDFEFLGNLSGDPYILHTNIFTQGKGNREQQFYLWFDPTKDFHTYSILWNPQHIIFSVDGIPIRDFKNLEKYRIPFPKIQPMRLYSSLWDADNWATRGGLVKTDWSKAPFTASYRNFQAQACVLSSGRSRCGSGGNRWFNQQLDVASLKRLRWVQKNYMIYNYCTDVKRFPQGIPTECKHP

SEQ ID NO: 717 - DNA, 1053 bp, Arabidopsis thaliana
  misc_feature 1..1053: note = Ceres Annot ID no. 878947
  misc_feature 1..1053: note = Encodes the peptide sequence at SEQ ID NO. 718
  source 1..1053: mol_type = other DNA
aacaaacctaagctcaaagcccaccaaaaagaaaacaatcacttagcaatggcgatgatcagttactccaccattgtggttgctctgcttgcttcttttatgatttgctctgtttccgccaattttcaacgagacgtagagataacttggggagacggacgtggacagatcacaaacaacggcgatcttcttacactctctctcgacaaagcttcaggctcaggattccaatccaagaacgaatatttgttcggtaaaatcgacatgcagatcaaactcgttgccggaaactccgctggaactgtcaccgcttactatttgaaatcccctggatctacatgggacgagattgactttgagttcttgggaaacctaagtggtgatccttacacacttcatactaatgtctttacgcaaggaaaaggcgatagagaacaacaattcaaactctggttcgatcccactagtgatttccacacttactctatcctctggaacccacaacgcatcatattctccgtggatggaactcccataagagaattcaagaacatggaatctcaaggaactctgtttcctaagaaccagccaatgagaatgtactctagtctatggaacgctgaagaatgggccacaaggggtggtctcgtcaaaaccgactggtctaaagctcccttcactgcttcctaccgcggcttcaacgaagaagcttgcgtcgtgatcaacggccagtcttcatgccctaacgtgtcaggacaagggagtactggttcgtggttgtctcaggagctagactcgacgggtcaagaacagatgagatgggtacagaataactacatgatttacaattactgtacggacgctaaaaggttccctcaaggtcttccacgcgagtgcttagctgcgtaaagcttttaaacaaatgatccaaagccatgaaaagtaatactattctttgattcatcttataaagtatctgatgtttggttacatctgttttttatttattctatgtaagtatatttgtattcgaatattgatcaatcactttac

SEQ ID NO: 718 - protein, 286 aa, Arabidopsis thaliana
  REGION 1..286: note = Ceres Annot ID no. 878947
  REGION 26..207: note = Pfam Name: Glyco_hydro_16 Pfam Description: Glycosyl hydrolases family 16
  REGION 231..283: note = Pfam Name: XET_C Pfam Description: Xyloglucan endo-transglycosylase (XET)
  REGION 1..286: note = Bit score of 634.3 for HMM based on sequences of Figure 11
  REGION 1..286: note = Functional Homolog Of SEQ ID NO. 641
MAMISYSTIVVALLASFMICSVSANFQRDVEITWGDGRGQITNNGDLLTLSLDKASGSGFQSKNEYLFGKIDMQIKLVAGNSAGTVTAYYLKSPGSTWDEIDFEFLGNLSGDPYTLHTNVFTQGKGDREQQFKLWFDPTSDFHTYSILWNPQRIIFSVDGTPIREFKNMESQGTLFPKNQPMRMYSSLWNAEEWATRGGLVKTDWSKAPFTASYRGFNEEACVVINGQSSCPNVSGQGSTGSWLSQELDSTGQEQMRWVQNNYMIYNYCTDAKRFPQGLPRECLAA

SEQ ID NO: 719 - DNA, 1137 bp, Brassica napus
  misc_feature 1..1137: note = Ceres Clone ID no. 1045431
  misc_feature 1..1137: note = Encodes the peptide sequence at SEQ ID NO. 720
  source 1..1137: mol_type = other DNA
acattcctcaccaaactccaaacacatacacccacacgtacgcacacataacaatgtctcctttcaaaatattcctcttctcagctctccttgcggcggcgtttttagcctccaccgctgatttcaacagcgacgtcaacgtggcttggggaaacggccgtgggaagatactcaacaacggccagcttctcactctcaccttagacaaatcatctggttctggttttcaatccaaaacagagtatttgttcggtaagattgatatgcagattaagcttgttcctggtaactcagcaggcacggtcacaactttctacctgaagtctgaaggatctacttgggatgagattgattttgagttcttgggtaatatgactggagatccttatactctacacactaatgtgtacactcaaggtaaaggtgacaaagagcaacagttccatctctggttcgacccaacagccaatttccacacttactcaatcctctggaaccctcaaagaatcatattaaccgtcgatgacacaccgattagagagtttaaaaactccgagtcgctcggtgttttatttccaaagagcaagccgatgaggatgtacgcaagtttatggaacgcagacgattgggcaactagaggcggtctggttaaaacagattggtccaaggctccattcactgcttcttacaggaacattaagattgatggttgtgctcattccaacggaagatcgtcttgtacctcaacgaaaccaacctctaattggtacactcaagaaatggattcgactagccaagctagactcagatgggttcagaagaattacatgatctataattactgtacggatactaagaggtttccgcagggaatccctagggaatgtgcaacaagatcatagaagctttaagagagatcatatacatttaatctatttatcctccgctgctttctttcgctttatatgtaaagtactctgcttcttctttagttactacttgtgtgttgattctttcgattgtgtgaatcttggtccaataaaagcaaattaaaggtgtgtctatatatacatgttaagagattgtctattgtaaacaaaaatgtgtatgcaaatgataatagttgcccattctttc

SEQ ID NO: 720 - protein, 282 aa, Brassica napus
  REGION 1..282: note = Ceres Clone ID no. 1045431
  REGION 24..205: note = Pfam Name: Glyco_hydro_16 Pfam Description: Glycosyl hydrolases family 16
  REGION 229..278: note = Pfam Name: XET_C Pfam Description: Xyloglucan endo-transglycosylase (XET)
  REGION 1..282: note = Bit score of 612.8 for HMM based on sequences of Figure 11
  REGION 1..282: note = Functional Homolog Of SEQ ID NO. 641
MSPFKIFLFSALLAAAFLASTADFNSDVNVAWGNGRGKILNNGQLLTLTLDKSSGSGFQSKTEYLFGKIDMQIKLVPGNSAGTVTTFYLKSEGSTWDEIDFEFLGNMTGDPYTLHTNVYTQGKGDKEQQFHLWFDPTANFHTYSILWNPQRIILTVDDTPIREFKNSESLGVLFPKSKPMRMYASLWNADDWATRGGLVKTDWSKAPFTASYRNIKIDGCAHSNGRSSCTSTKPTSNWYTQEMDSTSQARLRWVQKNYMIYNYCTDTKRFPQGIPRECATRS

SEQ ID NO: 721 - protein, 282 aa, unidentified
  REGION 1..282: note = Public GI ID no. 22947852
  REGION 24..205: note = Pfam Name: Glyco_hydro_16 Pfam Description: Glycosyl hydrolases family 16
  REGION 229..279: note = Pfam Name: XET_C Pfam Description: Xyloglucan endo-transglycosylase (XET)
  REGION 1..282: note = Bit score of 653.6 for HMM based on sequences of Figure 11
  REGION 1..282: note = Functional Homolog Of SEQ ID NO. 641
  source 1..282: note = Malus x domestica
MTKIFLVLVLLVFNVLVATSAGNFNQDFDITWGDGRAKILDNGQSLTLSLDKTSGSGFQSKNQYLFGKIDMQIKLVPGNSAGTVTAYYLSSLGSTHDEIDFEFLGNLSGDPYILHTNIFTQGKGNREQQFYLWFDPTKDFHTYSILWNPQTIIFSVDGTPIREFKNLESKGVSFPKDQGMWIYSSLWNADDWATRGGLVKTDWSKAPFTASYRNFNAQACTWSSGTSRCPSKSPNESSWLTQSLDSTGQERIKWVQKNYMIYNYCRDTKRFPQGFPPECSAA

SEQ ID NO: 722 - DNA, 1102 bp, Gossypium hirsutum
  misc_feature 1..1102: note = Ceres Clone ID no. 1855067
  misc_feature 1..1102: note = Encodes the peptide sequence at SEQ ID NO. 723
  source 1..1102: mol_type = other DNA
aatcacataaattctctgttttatctctgctctgcaaaattatcaaaatacaaaatgatcagtttttcgagtttcaagtttaccttgcttctgcctcttatggttggctgtcttatggcagcagcagcgagcaacttcaacaatgattttgacatcacatggggagacgggcgtggtaagattggcaacaatggagaggtcctcactctctccctcgataaatcttctggttctggtttccagtctaagaatgagtatctcttcggcaagattgatatgcagctcaagcttgtccctggaaactctgctggcactgtcactgcctactatctttcttcgaaaggatcaacatgggatgaaattgatttcgagttccttggaaatctaagtggtgatccttacattcttcacacaaatgtgttcagtcaaggcaagggtaacagagagcaacaattctatctctggtttgacccaactgcagatttccacacttattccatcctctggagcccccaaagtatcatattctctgtggacggtacacccattagagagttcaagaacatggagtcaattggtgtcccatttcctaaaaatcagccgatgagaatttactctagcttgtggaatgctgatgactgggctacaaggggtggtctggttaagactgactggaccctagctcctttcactgcctcttacaggaacttcaatgccgatgcctgtgtgtggtccaatggagcctcttcctgcaaatcgactgctacatcaacaaacagtgcatggttctctcaagagatggattccgcaaagcagcaaaggttgcaatgggtgcagaagaactacatgatctacaactactgcaatgacgctaacagatttcctcaaggtctaccgcctgagtgcagtatgtcttaaaagatttgaagagccaattagagaaacttcttttttgagatttatattcaatattctttcttttttttttctttattcaaaccacgttgcccattcttttcatcttctgaaaattctgatcactttgtatgtgccaagttattatgaaaagatatgaaaaattaagaggattttaatttccctt

SEQ ID NO: 723 - protein, 287 aa, Gossypium hirsutum
  REGION 1..287: note = Ceres Clone ID no. 1855067
  REGION 28..209: note = Pfam Name: Glyco_hydro_16 Pfam Description: Glycosyl hydrolases family 16
  REGION 233..284: note = Pfam Name: XET_C Pfam Description: Xyloglucan endo-transglycosylase (XET)
  REGION 1..287: note = Bit score of 644.6 for HMM based on sequences of Figure 11
  REGION 1..287: note = Functional Homolog Of SEQ ID NO. 641
MISFSSFKFTLLLPLMVGCLMAAAASNFNNDFDITWGDGRGKIGNNGEVLTLSLDKSSGSGFQSKNEYLFGKIDMQLKLVPGNSAGTVTAYYLSSKGSTWDEIDFEFLGNLSGDPYILHTNVFSQGKGNREQQFYLWFDPTADFHTYSILWSPQSIIFSVDGTPIREFKNMESIGVPFPKNQPMRIYSSLWNADDWATRGGLVKTDWTLAPFTASYRNFNADACVWSNGASSCKSTATSTNSAWFSQEMDSAKQQRLQWVQKNYMIYNYCNDANRFPQGLPPECSMS

SEQ ID NO: 724 - protein, 286 aa, Arabidopsis thaliana
  REGION 1..286: note = Public GI ID no. 17064792
  REGION 26..207: note = Pfam Name: Glyco_hydro_16 Pfam Description: Glycosyl hydrolases family 16
  REGION 231..283: note = Pfam Name: XET_C Pfam Description: Xyloglucan endo-transglycosylase (XET)
  REGION 1..286: note = Bit score of 631.0 for HMM based on sequences of Figure 11
  REGION 1..286: note = Functional Homolog Of SEQ ID NO. 641
MAMISYSTIVVALLASFMICSVSANFQRDVEITWGDGRGQITNNGDLLTLSLDKASGSGFQSKNEYLFGKIDMQIELVAGNSAGTVTAYYLKSPGSTWDEIDFEFLGNLSGDPYTLHTNVFTQGKGDREQQFKLWFDPTSDFHTYSILWNPQRIIFSVDGTPIREFKNMESQGTLFPKNQPMRMYSSLWNAEEWATRGGLVKTDWSKAPFTASYRGFNEEACVVINGQSSCPNVSGQGSTGSWLSQELDSTGQEQMRWVQNNYMIYNYCTDAKRFPQGLPRECLAA

SEQ ID NO: 725 - DNA, 1199 bp, Glycine max
  misc_feature 1..1199: note = Ceres Clone ID no. 662227
  misc_feature 1..1199: note = Encodes the peptide sequence at SEQ ID NO. 726
  source 1..1199: mol_type = other DNA
acaaccaataccatcaacacttcatttcttactctcactgaaaaaaaatagcttgttcacaccatcctattttttcaactcatatatacaaatatatataacatggcttctaccttctctcgaagcctagcacttgtaagcttttacattgtcgtttgtgctgccggtaacttgaaccaagactttcagcttacgtggggagatggtcgtgctaaaatactcaacaacgaaaatcttctcactctctcccttgacaaggcctctggctctggcttccaatccaaaaacgaatacttatatggcaagattgacatgcagctcaagctcgttcctggaaactctgctggcactgtcaccgcctattatctgtcttcaaaaggatcaacatgggatgagattgacttcgagttcttggggaatctgagtggcgatccatacattctacacaccaatgtgttcagccaaggcaagggcaacagagagcaacaattctatctctggtttgacccaactgcagatttccacacttattcaattctttggaatccccaacgcattgttttttctgtggatggcacccccatcagggaattcaagaatttggaatcaataggagttccttttccaaagagccaaccgatgaggatatactcaagcctatggaacgctgatgattgggccacaaggggtggactcatcaagactgactggtccaaagctcctttcactgcatcctacagaaacttcaacgccaatgcttgtgtttggaactctggaaaatcctcatgcaaatcaaattcttcaccttcctctgcatctcccactaatgcatggttatcacaagagcttgattccactgctcagcagaggttgcgttgggtgcagaagaactacttgatttacaattactgcaccgacaacaagagatttcctcaaggccttccactcgaatgcaaacactcctagagcctataggactcacatctcgcactacccataacaagtgttgcaatataatcttatgaaccattcttttaatttttgtattcctttttttttttttgttcgatgcttgagtgctatagtgctgttattatacaaatatacaatgtaaaaatatcccatgtaaaataatgcttctgtttttttttttaaaaaaaaaataatgcttctcttgtttgtatgactgaattttgtgt

SEQ ID NO: 726 - protein, 287 aa, Glycine max
  REGION 1..287: note = Ceres Clone ID no. 662227
  REGION 24..205: note = Pfam Name: Glyco_hydro_16 Pfam Description: Glycosyl hydrolases family 16
  REGION 229..284: note = Pfam Name: XET_C Pfam Description: Xyloglucan endo-transglycosylase (XET)
  REGION 1..287: note = Bit score of 654.6 for HMM based on sequences of Figure 11
  REGION 1..287: note = Functional Homolog Of SEQ ID NO. 641
MASTFSRSLALVSFYIVVCAAGNLNQDFQLTWGDGRAKILNNENLLTLSLDKASGSGFQSKNEYLYGKIDMQLKLVPGNSAGTVTAYYLSSKGSTWDEIDFEFLGNLSGDPYILHTNVFSQGKGNREQQFYLWFDPTADFHTYSILWNPQRIVFSVDGTPIREFKNLESIGVPFPKSQPMRIYSSLWNADDWATRGGLIKTDWSKAPFTASYRNFNANACVWNSGKSSCKSNSSPSSASPTNAWLSQELDSTAQQRLRWVQKNYLIYNYCTDNKRFPQGLPLECKHS

SEQ ID NO: 727 - protein, 289 aa, Vitis vinifera
  REGION 1..289: note = Public GI ID no. 225446109
  REGION 30..211: note = Pfam Name: Glyco_hydro_16 Pfam Description: Glycosyl hydrolases family 16
  REGION 236..288: note = Pfam Name: XET_C Pfam Description: Xyloglucan endo-transglycosylase (XET)
  REGION 1..289: note = Bit score of 631.7 for HMM based on sequences of Figure 11
  REGION 1..289: note = Functional Homolog Of SEQ ID NO. 641
MASSPFSSSSLLGLVVYMFCSLMAASAGNFYQEFDITWGNDRAKLLDKGQLLTLSLDRASGSGFKSKNEYLFGKIDMQLKLVPGNSAGTVTAYYFSSLGSTHDEIDFEFLGNLSGDPYILHTNVFSQGKGNREQQFYLWFDPTANFHTYSVLWNPHNILFSVDGTPIRVFKNLEAMGIPFPKKQPMRIYSSLWNADDWATRGGLVKTDWSQAPFTASYRNFDASNACVWSSGASSCSSKSPSSSNSPWMKHELDSTSQARLRWVQKNYMIYNYCTDTKRFPQSPPPECA

SEQ ID NO: 728 - DNA, 1091 bp, Glycine max
  misc_feature 1..1091: note = Ceres Clone ID no. 522574
  misc_feature 1..1091: note = Encodes the peptide sequence at SEQ ID NO. 729
  source 1..1091: mol_type = other DNA
atcaattaattgtgcacgaaataccaattctgtcccaaatattatactaacatattagaagctgtccaattccaatggttccttgtgttaaagcaatggttgcgcttgtcctagcgtttctaatctctttgccttctatggttgcctatgctggcaacatgtaccaagatgttgatgtcacgtggggagatggcagaggcaagattctgaacaatggtcagcttcttactctgtctcttgacagagcctctggctctggctttcagtccaagaatcagtatctatttggcaaaattgacatgcaaatcaaacttgtgcctgcaaattccgctggcacggtcaccgctttttacttacgttcagaagggtcatcttgggatgagatagattttgagttcctgggaaatctgagtggtgatccttacatagttcatactaatgtgtacacacaaggcaagggtaatagggagcaacaattttatctttggtttgacccaactgcagattttcacacctattcctttctctggaatcctacacatgttgtattctatgttgatggaagaccaattagggagttcaagaacttggagggagtgggtgttgaatacccaaagaagcagcctatgaggttatatgccagtctatggaacgctgatgactgggcaacgagaggagggctagtgaagacagattggagtcaagcaccattcactgcttctttcaggaacttcaaagccaatggttgcgtttggtccaatggggtttcttcatgcaactccacctcctcttctgaaaaagcttggctatattctcaacggcttgattccacaaaccagaagaagctaaaatgggtgcacaagaattacatgatttatgattactgcacagaccttaagcgattccctcagggtctccctctcgaatgcacagtccgcaccaagtcataacaaaaatatatgcaaactgctattgtatttgcatgtgtgtgcattccattttcccattacactgcatcgcttctcaatctcattctttatgcaattaatttggatacaaagggcatcgtaatgtaacaattaatgtttatt

SEQ ID NO: 729 - protein, 291 aa, Glycine max
  REGION 1..291: note = Ceres Clone ID no. 522574
  REGION 29..210: note = Pfam Name: Glyco_hydro_16 Pfam Description: Glycosyl hydrolases family 16
  REGION 234..285: note = Pfam Name: XET_C Pfam Description: Xyloglucan endo-transglycosylase (XET)
  REGION 1..291: note = Bit score of 614.7 for HMM based on sequences of Figure 11
  REGION 1..291: note = Functional Homolog Of SEQ ID NO. 641
MVPCVKAMVALVLAFLISLPSMVAYAGNMYQDVDVTWGDGRGKILNNGQLLTLSLDRASGSGFQSKNQYLFGKIDMQIKLVPANSAGTVTAFYLRSEGSSWDEIDFEFLGNLSGDPYIVHTNVYTQGKGNREQQFYLWFDPTADFHTYSFLWNPTHVVFYVDGRPIREFKNLEGVGVEYPKKQPMRLYASLWNADDWATRGGLVKTDWSQAPFTASFRNFKANGCVWSNGVSSCNSTSSSEKAWLYSQRLDSTNQKKLKWVHKNYMIYDYCTDLKRFPQGLPLECTVRTKS

SEQ ID NO: 730 - protein, 285 aa, Cucumis melo
  REGION 1..285: note = Public GI ID no. 115334954
  REGION 25..206: note = Pfam Name: Glyco_hydro_16 Pfam Description: Glycosyl hydrolases family 16
  REGION 230..282: note = Pfam Name: XET_C Pfam Description: Xyloglucan endo-transglycosylase (XET)
  REGION 1..285: note = Bit score of 645.2 for HMM based on sequences of Figure 11
  REGION 1..285: note = Functional Homolog Of SEQ ID NO. 641
MASPIMFLTLLFSAASLIAISSANFNQDFQITWGDGRAKILNNGELLTLSLDKASGSGFQSQNEYLFGKIDMQLKLVAGNSAGTVTAYYLSSKGSTWDEIDFEFLGNLTGDPYTLHTNVFSQGKGNREQQFHLWFDPTADFHTYSILWNPNRIVFSVDGTPIREFKNWESNGVPFPKDQPMRIYSSLWNADDWATRGGLVKTDWTKAPFTASYKNFKAEACVLSGGQSSCSPSAPAGSRNSWLSEEMDSVSQERLKWVQKNYMIYNYCTDTRRFPQGLPTECKLP

SEQ ID NO: 731 - DNA, 1019 bp, Glycine max
  misc_feature 1..1019: note = Ceres Clone ID no. 581426
  misc_feature 1..1019: note = Encodes the peptide sequence at SEQ ID NO. 732
  source 1..1019: mol_type = other DNA
atcaattaattgtgcacgaaataccaattctgtctcacatagttctataacaccacaaactgtccaattccaatggttgttttctcttgtgttaaaacaatggttgtgcttgtccttgcgtttctaatctctgtgccttctatggttgcttctgctgtcagcttgtaccaagatgttgatgtcacgtggggagatggcagaggtaagattctgaacaatggtcagcttcttactctgtctctcgacagagcctctggctctggctttcagtccaagaatcagtatctatatggcaaaattgacatgcaaatcaaacttgtccctggaaattccgctggcacggtcaccgctttttacttacgttcagaagggtcatcttgggatgagatagactttgagttcctgggaaatctgagtggtgatccttacatagttcatactaatgtgtacacacaaggcaagggtaatagggagcaacaattctatctttggtttgacccaactgcagattttcacacctattcctttctctggaatcctgcacatgttgtattctatgttgatggaagaccaattagggagttcaagaacttggagggtgcgggtattgaatacccaaagaaacagcctatgaggttatattcaagtctatggaacgctgatgactgggcaacaagaggagggcttgtgaagacagattggagtgaagcaccattcactgcttctttcaggaacttcagagccaatggttgcgtttggtccaatggggtttcttcatgcaactccagcacctcttctgaaaaagcttggctatattctcaacagcttgattccacaaaccagaagaagctaaaatgggtgcagaagaattacatgatttacgattattgcacagacctcaaacgattccctcagggtcttcctctggaatgcacggttcgcaccaagtcataagaaaaatatatgcaaactgcttttgtatttgtatatgtcaatatgtttgtgcattccattttccc

SEQ ID NO: 732 - protein, 293 aa, Glycine max
  REGION 1..293: note = Ceres Clone ID no. 581426
  REGION 31..212: note = Pfam Name: Glyco_hydro_16 Pfam Description: Glycosyl hydrolases family 16
  REGION 236..287: note = Pfam Name: XET_C Pfam Description: Xyloglucan endo-transglycosylase (XET)
  REGION 1..293: note = Bit score of 619.9 for HMM based on sequences of Figure 11
  REGION 1..293: note = Functional Homolog Of SEQ ID NO. 641
MVVFSCVKTMVVLVLAFLISVPSMVASAVSLYQDVDVTWGDGRGKILNNGQLLTLSLDRASGSGFQSKNQYLYGKIDMQIKLVPGNSAGTVTAFYLRSEGSSWDEIDFEFLGNLSGDPYIVHTNVYTQGKGNREQQFYLWFDPTADFHTYSFLWNPAHVVFYVDGRPIREFKNLEGAGIEYPKKQPMRLYSSLWNADDWATRGGLVKTDWSEAPFTASFRNFRANGCVWSNGVSSCNSSTSSEKAWLYSQQLDSTNQKKLKWVQKNYMIYDYCTDLKRFPQGLPLECTVRTKS

SEQ ID NO: 733 - protein, 284 aa, Populus tremula
  REGION 1..284: note = Public GI ID no. 124109191
  REGION 1..284: note = Populus tremula x Populus tremuloides
  REGION 25..206: note = Pfam Name: Glyco_hydro_16 Pfam Description: Glycosyl hydrolases family 16
  REGION 230..283: note = Pfam Name: XET_C Pfam Description: Xyloglucan endo-transglycosylase (XET)
  REGION 1..284: note = Bit score of 615.1 for HMM based on sequences of Figure 11
  REGION 1..284: note = Functional Homolog Of SEQ ID NO. 641
MGLFCNGFSLFVMVCSMAVVASGNFHQDFDLTWGDRRAKIFNGGQLLSLSLDKVSGSGFQSKKEYLFGRIDMQLKLVAGNSAGTVTAYYLSSQGPTHDEIDFEFLGNLSGDPYILHTNVFTQGKGNREQQFYLWFDPTRNFHTYSIIWNPQHIIFLVDSVPIRVFKNAESIGVPFPKSQPMRIYSSLWNADDWATRGGLVKTDWTKAPFNAYYRNFKANACTWSYGASSCGSKPSSAFSDGAWKTNELDAPSRRRLRWVQKYFMIYNYCTDLRRFPQGPPPECK

SEQ ID NO: 734 - DNA, 807 bp, Populus balsamifera
  misc_feature 1..807: note = Ceres Annot ID no. 1471882
  misc_feature 1..807: note = Encodes the peptide sequence at SEQ ID NO. 735
  source 1..807: mol_type = other DNA
atggcggtggttgcttcaggcaacttctatcaggattttgacttaacatggggtgaccgacgtgcaaagatattcaacggaggacagcttctgtctttgtctctagacaaggtttctgggtctggatttcagtccaagaaggagtacttgttcgggaggattgatatgcagctcaaacttgtcgctggcaactctgctggcactgtaacagcctactatttgtcttcgcaaggaccaacgcatgacgagatcgacttcgagttcttgggaaaccttagtggcgacccttatattttgcacactaacgtattcactcaggggaagggaaacagagagcagcaattctatctctggtttgaccccacgaggaacttccacacttactccatcatctggaatcctcagcacatcatcttcttggtggacagtattcccatcagggtgttcaaaaatgctgaatcaattggagttccatttcccaagagccaacccatgaggatttactctagcctctggaatgctgatgactgggctacaagaggtggattggtcaaaactgactggactaaggcgcccttcaccgcatactatagaaacttcaaggccaatgcctgtacttggtcttacggtacttcttcttgtggttccaagccttccagcgctttctctgacggtgcatggaaaaccaatgagcttgatgctccaagtagaagaagactgagatgggttcagaaatatttcatgatttacaactactgcactgacctgagacgcttccctcagggtccccctcctgagtgcaaatag

SEQ ID NO: 735 - protein, 268 aa, Populus trichocarpa
  REGION 1..268: note = Ceres Annot ID no. 1471882
  REGION 9..190: note = Pfam Name: Glyco_hydro_16 Pfam Description: Glycosyl hydrolases family 16
  REGION 214..267: note = Pfam Name: XET_C Pfam Description: Xyloglucan endo-transglycosylase (XET)
  REGION 1..268: note = Bit score of 594.4 for HMM based on sequences of Figure 11
  REGION 1..268: note = Functional Homolog Of SEQ ID NO. 641
MAVVASGNFYQDFDLTWGDRRAKIFNGGQLLSLSLDKVSGSGFQSKKEYLFGRIDMQLKLVAGNSAGTVTAYYLSSQGPTHDEIDFEFLGNLSGDPYILHTNVFTQGKGNREQQFYLWFDPTRNFHTYSIIWNPQHIIFLVDSIPIRVFKNAESIGVPFPKSQPMRIYSSLWNADDWATRGGLVKTDWTKAPFTAYYRNFKANACTWSYGTSSCGSKPSSAFSDGAWKTNELDAPSRRRLRWVQKYFMIYNYCTDLRRFPQGPPPECK

SEQ ID NO: 736 - protein, 284 aa, Beta vulgaris
  REGION 1..284: note = Public GI ID no. 34809190
  REGION 24..205: note = Pfam Name: Glyco_hydro_16 Pfam Description: Glycosyl hydrolases family 16
  REGION 229..281: note = Pfam Name: XET_C Pfam Description: Xyloglucan endo-transglycosylase (XET)
  REGION 1..284: note = Bit score of 623.4 for HMM based on sequences of Figure 11
  REGION 1..284: note = Functional Homolog Of SEQ ID NO. 641
MASSSIVFATIFLASLIATTRANFNNDFAITWGDGRAKILNNGDDLTLSLDKATGSGFQSKNEYLFGSIDMQLKLVPGNSAGHVTAYYLSSFGYNPDEIDFEFLGNASGQPYTLHTNVFAQGKGNREQQFHLWFDPTKDFHTYSILWNPQRIVFSVDGIPIREFKNMESQGVSFPKNQPMRIYSSLWNADDWATQGGRVKTDWTHAPFTASYRNFNANACVWASGSSSCGSSPSADSGSDWLNQELDSASLERMRWVQTNYMVYNYCADLQRFPQGLPTECTTT

SEQ ID NO: 737 - protein, 291 aa, Cucumis sativus
  REGION 1..291: note = Public GI ID no. 29500893
  REGION 29..210: note = Pfam Name: Glyco_hydro_16 Pfam Description: Glycosyl hydrolases family 16
  REGION 234..287: note = Pfam Name: XET_C Pfam Description: Xyloglucan endo-transglycosylase (XET)
  REGION 1..291: note = Bit score of 627.5 for HMM based on sequences of Figure 11
  REGION 1..291: note = Functional Homolog Of SEQ ID NO. 641
MASSSVFSTTLFLSLLFTSFFLPSSASNFHQSTDITWGDGRAQILNNGDLLSLSLDKASGSGFQSRNEYLYGKIDMQIKLVPGNSAGTVTAYYLRSEGSTWDEIDFEFLGNLSGDPYTVHTNVFSQGKGNREQQFHLWFDPTADFHTYSILWNPQRIVFYVDGTPIREFKNMESIGVAFPKNQPMRLQSSLWNADDWATRGGLIKTDWTQAPFTASYRNFNENACIWSSGQSSCGSNSSPAASDKPWYSQELDTDSEGKLKWVQKNYMIYNYCTDVNRFPQGLPPECNGTA

SEQ ID NO: 738 - DNA, 885 bp, Populus balsamifera
  misc_feature 1..885: note = Ceres Annot ID no. 1452398
  misc_feature 1..885: note = Encodes the peptide sequence at SEQ ID NO. 739
  source 1..885: mol_type = other DNA
atgtcattctcttgtcctagtaaacttccctcgacgcttctgtttgcttcattacttgcttgtctactgggagcctccatgggtggcaatttcttccaagattttgacatcacctggggcgatcaacgtgctaagatactaaatggtggccaacttctcacactatctcttgacaaggattctggttctggcttccgatccaagaatgagtacttgtttggccgaatcgacatgcaaatcaagctagtatcgggcaactcggctggcactgtcaccacatactatctatcttctcaagggccgacccacgacgagattgacttcgagtttctaggcaatgtaactggagaaccatatactctccataccaatgtgttctcccaagggaaaggcaacaaagaacagcagttttatctctggtttgatcccacaaaggctttccacacctactctattgtgtggaaccaacaacgaataattttcttggtggacaacatccccataagagtattccacaactcggaatcaatcggagtgccgttcccgacgaagcaacccatgaggatatattcgagtctctggaatgctgatgattgggcaacgagaggggggcttgtgaagactgactggacacaagctcctttcactgcttcttacagaaatttcaaagccagtgcttgtgtttcgtcacctggatcatcttgcacctccacctcccccaattccttgcaggacagtacctggcaagttcaagctcttgatgcctccggccgcaacaggcttcgatgggtgcagcagaagtacatgatttacaactactgcactgacttgaaacgattccctcagggtatcccagctgaatgcaagcgatcaagattcctttga

SEQ ID NO: 739 - protein, 294 aa, Populus trichocarpa
  REGION 1..294: note = Ceres Annot ID no. 1452398
  REGION 1..294: note = Populus balsamifera subsp. trichocarpa
  REGION 31..212: note = Pfam Name: Glyco_hydro_16 Pfam Description: Glycosyl hydrolases family 16
  REGION 235..288: note = Pfam Name: XET_C Pfam Description: Xyloglucan endo-transglycosylase (XET)
  REGION 1..294: note = Bit score of 606.1 for HMM based on sequences of Figure 11
  REGION 1..294: note = Functional Homolog Of SEQ ID NO. 641
MSFSCPSKLPSTLLFASLLACLLGASMGGNFFQDFDITWGDQRAKILNGGQLLTLSLDKDSGSGFRSKNEYLFGRIDMQIKLVSGNSAGTVTTYYLSSQGPTHDEIDFEFLGNVTGEPYTLHTNVFSQGKGNKEQQFYLWFDPTKAFHTYSIVWNQQRIIFLVDNIPIRVFHNSESIGVPFPTKQPMRIYSSLWNADDWATRGGLVKTDWTQAPFTASYRNFKASACVSSPGSSCTSTSPNSLQDSTWQVQALDASGRNRLRWVQQKYMIYNYCTDLKRFPQGIPAECKRSRFL

SEQ ID NO: 740 - protein, 288 aa, Populus tremula
  REGION 1..288: note = Public GI ID no. 124109199
  REGION 1..288: note = Populus tremula x Populus tremuloides
  REGION 25..206: note = Pfam Name: Glyco_hydro_16 Pfam Description: Glycosyl hydrolases family 16
  REGION 230..283: note = Pfam Name: XET_C Pfam Description: Xyloglucan endo-transglycosylase (XET)
  REGION 1..288: note = Bit score of 610.8 for HMM based on sequences of Figure 11
  REGION 1..288: note = Functional Homolog Of SEQ ID NO. 641
MGVFCNGFSLFLIACSMVVVASGSFYQDFDLTWGDHRAKIFNGGQLLSLSLDKVSGSGFKSKKEYLFGRIDMQLKLVAGNSAGTVTAYYLSSQGPTHDEIDFEFLGNLTGDPYILHTNVFTQGKGNREQQFYLWFDPTRNFHTYSIIWSQQHIIFLVDNFPIRVFKNAESIGVPFPKSQPMRIYSSLWNADDWATRGGLVKTDWTKAPFTAYYRNFKADACTWSYGTSSCGSSSSSSFSDRSWQTNALDAPSRRRLRWVQKYFMIYNYCADLKRFPQGLPPECRRSRF

SEQ ID NO: 741 - DNA, 861 bp, Populus balsamifera
  misc_feature 1..861: note = Ceres Annot ID no. 1478206
  misc_feature 1..861: note = Encodes the peptide sequence at SEQ ID NO. 742
  source 1..861: mol_type = other DNA
atggcttctttgaatactgtgcttgtgccccttgtggctcttcttgtgacggttgcatcagcaagcaacttctacaacgattttgatattacctggggagatggtcgtgctaagatcctcagcaacggcgagctcctcactctcaaccttgacaaggcctctggctctggatttcaatccaggaatgagtatctgttcggaaagattgacatgcaactcaagcttgtccctggcaactctgcaggcactgtcactgcttattatctgtcatcaaaagggtctgcatgggatgagatagattttgaattcctggggaatttgagcggtgatccttacatcctgcacactaatgtgtttagccaaggcaagggcaacagagagcagcaattctatctttggtttgacccaactgctgatttccacacctattccattctgtggaatccacagcgcattgtcttctctgtggatggcactccaattcgagagttcaagaacctggagtctatgggggttccctttccaaaaaaccagccgatgaggatttactcgagtctatggaatgctgatgactgggctacaagaggtggcttggtcaagacagattgggccctggctcctttcaccgcttcttatagaaatttcaatgccgaagcttgtgttttgtctaatggggcatcttcttgtggcacaaccacttctcctcccgcccccacctcgaatgcttggttctcagaggagcttgattcaacaaggcaggagaggttgaaatgggcccgggagaattacatggtatacaattactgcaaagatatcaatagatttccccaaggtctacctccggaatgcagcatgtcctag

SEQ ID NO: 742 - protein, 286 aa, Populus trichocarpa
  REGION 1..286: note = Ceres Annot ID no. 1478206
  REGION 24..205: note = Pfam Name: Glyco_hydro_16 Pfam Description: Glycosyl hydrolases family 16
  REGION 229..283: note = Pfam Name: XET_C Pfam Description: Xyloglucan endo-transglycosylase (XET)
  REGION 1..286: note = Bit score of 651.4 for HMM based on sequences of Figure 11
  REGION 1..286: note = Functional Homolog Of SEQ ID NO. 641
MASLNTVLVPLVALLVTVASASNFYNDFDITWGDGRAKILSNGELLTLNLDKASGSGFQSRNEYLFGKIDMQLKLVPGNSAGTVTAYYLSSKGSAWDEIDFEFLGNLSGDPYILHTNVFSQGKGNREQQFYLWFDPTADFHTYSILWNPQRIVFSVDGTPIREFKNLESMGVPFPKNQPMRIYSSLWNADDWATRGGLVKTDWALAPFTASYRNFNAEACVLSNGASSCGTTTSPPAPTSNAWFSEELDSTRQERLKWARENYMVYNYCKDINRFPQGLPPECSMS

SEQ ID NO: 743 - DNA, 867 bp, Populus balsamifera
  misc_feature 1..867: note = Ceres Annot ID no. 1445599
  misc_feature 1..867: note = Encodes the peptide sequence at SEQ ID NO. 744
  source 1..867: mol_type = other DNA
atggggctgttctgcaatggattctctctgtttctgatagtttgctccatggtggtggttgcttctggtagtttctatcaggattttgacttgacatggggcgaccaccgggcaaagatattcaacggaggacagctcctctccctgtctctagacaaggtttctgggtctggatttcagtccaagaaggaatacttgtttgggaggattgatatgcagctcaaacttgttgccggcaactctgctggcactgtaacagcctactacttgtcttctcaaggagcaacacatgacgagatcgacttcgagttcttggggaacctcagcggcgacccttacattttgcacactaatgtgttcactcaggggaagggaaacagagagcagcaattctatctctggtttgaccccacaagaaacttccacacttactccatcatctggagccaacaacacatcattttcttggtggataattttcccataagggtgttcaagaatgccgaatcaattggagttcctttccccaagagccagcccatgaggatttactccagcctctggaacgccgatgactgggctacaagaggcgggttggtgaagacggactggacgaaggcaccctttacagcttactacagaaacttcaaagctgatgcctgtacttggtcctatggcacttcttcctgtggttccaggtcttccagttctttctctgatcgtgcatggcataccaacgccctcgatgctccaagcagaagaagactgagatgggtccagaaatacttcatgatttacaactactgcgctgacctaaaacgcttccctcaaggtctccctcctgagtgcagacgctcaagattctga

SEQ ID NO: 744 - protein, 288 aa, Populus trichocarpa
  REGION 1..288: note = Ceres Annot ID no. 1445599
  REGION 25..206: note = Pfam Name: Glyco_hydro_16 Pfam Description: Glycosyl hydrolases family 16
  REGION 230..283: note = Pfam Name: XET_C Pfam Description: Xyloglucan endo-transglycosylase (XET)
  REGION 1..288: note = Bit score of 613.3 for HMM based on sequences of Figure 11
  REGION 1..288: note = Functional Homolog Of SEQ ID NO. 641
MGLFCNGFSLFLIVCSMVVVASGSFYQDFDLTWGDHRAKIFNGGQLLSLSLDKVSGSGFQSKKEYLFGRIDMQLKLVAGNSAGTVTAYYLSSQGATHDEIDFEFLGNLSGDPYILHTNVFTQGKGNREQQFYLWFDPTRNFHTYSIIWSQQHIIFLVDNFPIRVFKNAESIGVPFPKSQPMRIYSSLWNADDWATRGGLVKTDWTKAPFTAYYRNFKADACTWSYGTSSCGSRSSSSFSDRAWHTNALDAPSRRRLRWVQKYFMIYNYCADLKRFPQGLPPECRRSRF

SEQ ID NO: 745 - DNA, 885 bp, Populus balsamifera
  misc_feature 1..885: note = Ceres Annot ID no. 1452397
  misc_feature 1..885: note = Encodes the peptide sequence at SEQ ID NO. 746
  source 1..885: mol_type = other DNA
atgtctttctcttgttcgagtagactttcttccatgcctttgtttgctctgttaattgcttgtctagtgggagcctccatgggtggcaatttcttccaagattttgacatcacctggggcgatcaacgtgctaagatactaaatggtggccaacttctcacactatctcttgacaaggattctggttctggcttccgatccaagaatgagtacttgtttggccgaatcgacatgcaaatcaagctagtatcgggcaactcggctggcactgtcaccacatactatctatcttctcaagggccgacccacgacgagattgacttcgagtttctaggcaatttaactggagaaccatatactctccataccaatgtgttctcccaagggaaaggcaacaaagaacagcagttttatctctggtttgatcccacaaaggctttccacacctactctattgtgtggaaccaacaacaaataattttcttggtggacaacatccccataagagtattccacaactcggaatcaatcggagtgccgttcccgacgaagcaacccatgaggatatattcgagtctctggaatgctgatgattgggcaacgagaggggggcttgtgaagactgactggacacaagctcctttcactgcttcttacagaaatttcaaagccagtgcttgtgtttcgtcacctggatcatcttgcacctccacctcccccaattccttgcaggacagtacctggcaagttcaaggtcttgatgcctccggccgcaacaggcttcgatgggtgcagcagaagtacatgatttacaactactgcactgacttgaaacgattccctcagggtatcccagctgaatgcaagcgatcaagattcctttga

SEQ ID NO: 746 - protein, 294 aa, Populus trichocarpa
  REGION 1..294: note = Ceres Annot ID no. 1452397
  REGION 31..212: note = Pfam Name: Glyco_hydro_16 Pfam Description: Glycosyl hydrolases family 16
  REGION 235..288: note = Pfam Name: XET_C Pfam Description: Xyloglucan endo-transglycosylase (XET)
  REGION 1..294: note = Bit score of 608.8 for HMM based on sequences of Figure 11
  REGION 1..294: note = Functional Homolog Of SEQ ID NO. 641
MSFSCSSRLSSMPLFALLIACLVGASMGGNFFQDFDITWGDQRAKILNGGQLLTLSLDKDSGSGFRSKNEYLFGRIDMQIKLVSGNSAGTVTTYYLSSQGPTHDEIDFEFLGNLTGEPYTLHTNVFSQGKGNKEQQFYLWFDPTKAFHTYSIVWNQQQIIFLVDNIPIRVFHNSESIGVPFPTKQPMRIYSSLWNADDWATRGGLVKTDWTQAPFTASYRNFKASACVSSPGSSCTSTSPNSLQDSTWQVQGLDASGRNRLRWVQQKYMIYNYCTDLKRFPQGIPAECKRSRFL

SEQ ID NO: 747 - protein, 285 aa, Glycine max
  REGION 1..285: note = Public GI ID no. 19911573
  REGION 24..205: note = Pfam Name: Glyco_hydro_16 Pfam Description: Glycosyl hydrolases family 16
  REGION 229..282: note = Pfam Name: XET_C Pfam Description: Xyloglucan endo-transglycosylase (XET)
  REGION 1..285: note = Bit score of 652.5 for HMM based on sequences of Figure 11
  REGION 1..285: note = Functional Homolog Of SEQ ID NO. 641
MAFSRVALLICTVGYFVIASAGNFHQDFDITWGDGRAKILNNGELLTLSLDKASGSGFQSKNEYLFGKIDMQLKLVPGNSAGTVTAYYLSSKGATWDEIDFEFLGNLSGDPYILHTNVFSQGKGNREQQFYLWFDPTADFHTYSILWNPQRIVFSVDGSPIREFKNMESKGVPFPKNQAMRIYSSLWNADDWATRGGLVKTDWTQAPFTASYRNFNANACTMSSGTSSCGSNNPSSSNNNVWLSEELDSTDQERLKWVQKNYMIYNYCSDTQRFPQGLPSECNTA

SEQ ID NO: 748 - protein, 281 aa, Populus tremula
  REGION 1..281: note = Public GI ID no. 124109181
  REGION 23..204: note = Pfam Name: Glyco_hydro_16 Pfam Description: Glycosyl hydrolases family 16
  REGION 228..278: note = Pfam Name: XET_C Pfam Description: Xyloglucan endo-transglycosylase (XET)
  REGION 1..281: note = Bit score of 624.6 for HMM based on sequences of Figure 11
  REGION 1..281: note = Functional Homolog Of SEQ ID NO. 641
MFTCFTVISFLFMAAAAMAAGNFNQQFDTTWGDGRARVLQNGQLLTLSLDKTSGSGFKSKSQYLFGKIDMQLKLVPGNSAGTVTAYYLSSLGSAHDEIDFEFLGNLSGDPYILHTNVFTQGKGNREQQFYLWFDPTKDFHTYSVLWNPLSIILSVDGTPIREFKNMESKGIPYPKSQPMWIYSSLWNADDWATRGGLIKTDWSQAPFTASYRNFNAQACTWTSGSSSCSSSGSSSNSWLSQSLGSTGQGRIKWVQKNYMIYNYCTDTKRFPQGSPPECSMA

SEQ ID NO: 749 - protein, 284 aa, Arabidopsis thaliana
  REGION 1..284: note = Public GI ID no. 22327914
  REGION 30..211: note = Pfam Name: Glyco_hydro_16 Pfam Description: Glycosyl hydrolases family 16
  REGION 235..282: note = Pfam Name: XET_C Pfam Description: Xyloglucan endo-transglycosylase (XET)
  REGION 1..284: note = Bit score of 599.7 for HMM based on sequences of Figure 11
  REGION 1..284: note = Functional Homolog Of SEQ ID NO. 641
MDRSTFILSLLFTLTVSTTTLFSPVFAGTFDTEFDITWGDGRGKVLNNGELLTLSLDRASGSGFQTKKEYLFGKIDMQLKLVPGNSAGTVTAYYLKSKGDTWDEIDFEFLGNLTGDPYTMHTNVYTQGKGDREQQFHLWFDPTADFHTYSVLWNPHHIVFMVDDIPVREFKNLQHMGIQYPKLQPMRLYSSLWNADQWATRGGLVKTDWSKAPFTASYRNFRADACVSSGGRSSCPAGSPRWFSQRLDLTAEDKMRVVQRKYMIYNYCTDTKRFPQGFPKECRH

SEQ ID NO: 750 - protein, 290 aa, Solanum lycopersicum
  REGION 1..290: note = Public GI ID no. 42795468
  REGION 28..209: note = Pfam Name: Glyco_hydro_16 Pfam Description: Glycosyl hydrolases family 16
  REGION 224..285: note = Pfam Name: XET_C Pfam Description: Xyloglucan endo-transglycosylase (XET)
  REGION 1..290: note = Bit score of 548.0 for HMM based on sequences of Figure 11
  REGION 1..290: note = Functional Homolog Of SEQ ID NO. 641
MSSKFSSTLLLLISILMSIQLLASAGNFYRDVDITWGEGRGKIQEGGRGLALSLDKLSGSGFQSKNEYLFGRFDMQLKLVPKNSAGTVTTFFLSSQGEGHDEIDFEFLGNVSGQPYTIHTNVYTQGKGNKEQQFHLWFDPTAAFHTYTIVWNPHRIVFLVDNSPIRVFNNHESMGIPFPKSQAMKVYCSLWNADEWATQGGRVKTDWALAPFTAYYRNINIDGCAVSSGASTCKSIGSTNNAKPWQTHELDGKGRNRLRWVQTKHMVYNYCADSKRFPQGFSAECKSSRF

SEQ ID NO: 751 - protein, 287 aa, Solanum lycopersicum
  REGION 1..287: note = Public GI ID no. 42795462
  REGION 27..208: note = Pfam Name: Glyco_hydro_16 Pfam Description: Glycosyl hydrolases family 16
  REGION 231..283: note = Pfam Name: XET_C Pfam Description: Xyloglucan endo-transglycosylase (XET)
  REGION 1..287: note = Bit score of 639.3 for HMM based on sequences of Figure 11
  REGION 1..287: note = Functional Homolog Of SEQ ID NO. 641
MASSSSKLVLVMCFMISAFGIAIGAKFDQEFDITWGDGRAKILNNGDLLTLSLDKISGSGFQSKNEYLFGKIDMQLKLVPGNSAGTVTAYYLSSQGPTHDEIDFEFLGNLSGDPYTLHTNVFSQGKGNREQQFHLWFDPTADFHTYSITWNPQRIIFYVDGTPIREYKNSESIGVSYPKNQPMRIYSSLWNADDWATRGGLVKTDWSQAPFSASYRNFSANACIPTSSSSCSSNSAASTSNSWLNEELDNTSQERLKWVQKNYMVYDYCTDSKRFPQGFPADCVQNI

SEQ ID NO: 752 - DNA, 819 bp, Populus balsamifera
  misc_feature 1..819: note = Ceres Annot ID no. 1466060
  misc_feature 1..819: note = Encodes the peptide sequence at SEQ ID NO. 753
  source 1..819: mol_type = other DNA
atggctgcttcagctggtaatttcaatcaagaagttgacctaacatggggtggtgatcgtgctaagatactcagtggaggaagcgttctgtctcttacacttgataaggtctccggctctggctttcaatccaagagcgagtatctcttcggaaggatagatatgcagatcaagcttgttggtggtaactctgctggttctgtcactgcttactatttatcctcagaagggccataccatgatgaaattgattttgagttcttagggaaccttagcggagaaccctatactgttcacactaatgtgtacactcaagggaaaggggatagggaacaacagttccacctttggtttgatccaacaaaagattttcacttgtattctgttgtatggaaccaccaacgtatcattttcttagtggatgacacgcctataagagtgtacgaaaatcaagaatccattggagttcccttcccgaagaaccaaccgatgaaactttactccagcctatggaatgctgatcaatgggcgacaagaggtggactagtgaaagcagattggtctaaggcacctttcacagcatactacaggaatttcaaagccaacgcgtgcttatggtcttcaggatcgtcttcttgttcattgaagactactagctccagcacaaacaatgcttggcagactcaaggtctggattcgactagtcgtagaagccttagatgggtgcaaaaatactacatgatttacaattattgcacggattataagagatttcctatgggtcgcccgcgtgagtgcaggctttctaagcatttttag

SEQ ID NO: 753 - protein, 272 aa, Populus trichocarpa
  REGION 1..272: note = Ceres Annot ID no. 1466060
  REGION 8..189: note = Pfam Name: Glyco_hydro_16 Pfam Description: Glycosyl hydrolases family 16
  REGION 213..266: note = Pfam Name: XET_C Pfam Description: Xyloglucan endo-transglycosylase (XET)
  REGION 1..272: note = Bit score of 565.2 for HMM based on sequences of Figure 11
  REGION 1..272: note = Functional Homolog Of SEQ ID NO. 641
MAASAGNFNQEVDLTWGGDRAKILSGGSVLSLTLDKVSGSGFQSKSEYLFGRIDMQIKLVGGNSAGSVTAYYLSSEGPYHDEIDFEFLGNLSGEPYTVHTNVYTQGKGDREQQFHLWFDPTKDFHLYSVVWNHQRIIFLVDDTPIRVYENQESIGVPFPKNQPMKLYSSLWNADQWATRGGLVKADWSKAPFTAYYRNFKANACLWSSGSSSCSLKTTSSSTNNAWQTQGLDSTSRRSLRWVQKYYMIYNYCTDYKRFPMGRPRECRLSKHF

SEQ ID NO: 754 - DNA, 873 bp, Solanum lycopersicum
  misc_feature 1..873: note = Ceres Annot ID no. 8461207
  misc_feature 1..873: note = Encodes the peptide sequence at SEQ ID NO. 755
  source 1..873: mol_type = other DNA
atggctaattctcatttacttttaatttccattgtattaatgggcaatttagtggctgtattagcagctggtaattttaatgaccttacagaaatcacttggggtgatggacgtggtaaaatattagatggaggtaaaggtctctctttgtcacttgataattattccgggtcgggttttcaatcgaaaaatgaatatctctacggaagattcgacatgcaactcaaactcgtccctaaaaactctgctggcactgtcaccacgttctttctatcgtcacaaggagaaggacacgatgagatcgatttcgagttcttgggaaatgtgactggtgagccttatacggtacacaccaatgtttattctcaaggaaaaggaaacaaagaacaacaatttcacctttggttcgatccaactgcagcatttcacacttacaccattgtttggaacgctaaccgcatagtgtttttggtggatcagattccaattagagtatacaacaaccatgagagcattggaattgcataccccaaaagtcaaccaatgaaagtctattgtagtttatggaatgcagatgaatgggctacacaaggtggtagagtcaaaactgattggtcacaagcaccatttactgcctattataggaacattaacattgatggctgcgtcgttaaatcaggcgcttcctcatgtgcctcacggtctactgaatccacgaacagtgctaagtcgtgggagacacatgagcttgatgctaagggtcggaacagggtccgatgggtacagagcaaacatatggtttataattattgcgcggattctaagaggtttcctcaaggatattcacaagagtgtaaacgatcaaggttttaa

SEQ ID NO: 755 - protein, 290 aa, Solanum lycopersicum
  REGION 1..290: note = Ceres Annot ID no. 8461207
  REGION 26..207: note = Pfam Name: Glyco_hydro_16 Pfam Description: Glycosyl hydrolases family 16
  REGION 231..285: note = Pfam Name: XET_C Pfam Description: Xyloglucan endo-transglycosylase (XET)
  REGION 1..290: note = Bit score of 567.5 for HMM based on sequences of Figure 11
  REGION 1..290: note = Functional Homolog Of SEQ ID NO. 641
MANSHLLLISIVLMGNLVAVLAAGNFNDLTEITWGDGRGKILDGGKGLSLSLDNYSGSGFQSKNEYLYGRFDMQLKLVPKNSAGTVTTFFLSSQGEGHDEIDFEFLGNVTGEPYTVHTNVYSQGKGNKEQQFHLWFDPTAAFHTYTIVWNANRIVFLVDQIPIRVYNNHESIGIAYPKSQPMKVYCSLWNADEWATQGGRVKTDWSQAPFTAYYRNINIDGCVVKSGASSCASRSTESTNSAKSWETHELDAKGRNRVRWVQSKHMVYNYCADSKRFPQGYSQECKRSRF

SEQ ID NO: 756 - DNA, 846 bp, Populus balsamifera
  misc_feature 1..846: note = Ceres Annot ID no. 1506985
  misc_feature 1..846: note = Encodes the peptide sequence at SEQ ID NO. 757
  source 1..846: mol_type = other DNA
atgtttacttgttttactgtaataagttttttatttatggcagctgccatggctgctggtaacttcaaccagcaatttgacactacatggggtgatggccgtgctaaagtccttcaaaatggccaacttcttacactctctcttgacaaaacctctggttcagggtttaagtccaagaaccaatacttgtttgggaaaatcgacatgcaactaaagttggtacctggaaactctgccggaactgtcaccgcttactatctatcttctttgggatcagcgcatgatgaaatagattttgagttccttggtaaccttagtggagacccttatattcttcacaccaacgtcttcactcaaggaaaaggaaacagagagcagcaattctatctttggttcgaccccaccaaagatttccacacctattccgttctttggaatcctcttatgaaattatacttttctgtggatgggacaccaattagagagttcaagaacatggaatcaaagggcatcccatacccaaagagccaaccaatgtggatatactcaagcctctggaatgcagatgactgggctacaagaggaggtcttatcaaaaccgattggagccaagcaccgtttacagcttcttacaggaactttaatgctcaagcatgcacttggacctctggctcctcctcttgctcctcctctggctcctccagtaactcttggctatcacagtcactgggtagcacaggccaaggaagaataaaatgggtgcaaaagaactacatgatttataactattgcactgacaccaagcgattcccacaaggaccgcctccggaatgctcagtggcatga

SEQ ID NO: 757 - protein, 281 aa, Populus trichocarpa
  REGION 1..281: note = Ceres Annot ID no. 1506985
  REGION 22..204: note = Pfam Name: Glyco_hydro_16 Pfam Description: Glycosyl hydrolases family 16
  REGION 228..278: note = Pfam Name: XET_C Pfam Description: Xyloglucan endo-transglycosylase (XET)
  REGION 1..281: note = Bit score of 617.8 for HMM based on sequences of Figure 11
  REGION 1..281: note = Functional Homolog Of SEQ ID NO. 641
MFTCFTVISFLFMAAAMAAGNFNQQFDTTWGDGRAKVLQNGQLLTLSLDKTSGSGFKSKNQYLFGKIDMQLKLVPGNSAGTVTAYYLSSLGSAHDEIDFEFLGNLSGDPYILHTNVFTQGKGNREQQFYLWFDPTKDFHTYSVLWNPLMKLYFSVDGTPIREFKNMESKGIPYPKSQPMWIYSSLWNADDWATRGGLIKTDWSQAPFTASYRNFNAQACTWTSGSSSCSSSGSSSNSWLSQSLGSTGQGRIKWVQKNYMIYNYCTDTKRFPQGPPPECSVA

SEQ ID NO: 758 - protein, 292 aa, Fagus sylvatica
  REGION 1..292: note = Public GI ID no. 3901012
  REGION 28..209: note = Pfam Name: Glyco_hydro_16 Pfam Description: Glycosyl hydrolases family 16
  REGION 233..287: note = Pfam Name: XET_C Pfam Description: Xyloglucan endo-transglycosylase (XET)
  REGION 1..292: note = Bit score of 636.4 for HMM based on sequences of Figure 11
  REGION 1..292: note = Functional Homolog Of SEQ ID NO. 641
MASVLVKLLLLLTILASSVLVIAYAGNLHQDFDITWGDGRAMILNNGELLTLSLDKASGSGFQSKNQFLFGKIDTQIKLVPGNSAGTVTAYYLSSKGSTWDEIDYEFLGNLSGDPYTIHTNIYTQGKGNREQQFHLWFDPTANFHTYSILWNPQAIIFSVDGTPIREFKNSESIGVPIPKKQPMRLYSSLWNADDWATRGGLLKTDWARTPFTASYRNFNARACLWSSGESTCTANSQSSTSNNNAWLKEDLDFTRQERLKWVQKNYMIYNYCTDTKRFPQGFPPECAATKA

SEQ ID NO: 759 - DNA, 819 bp, Populus balsamifera
  misc_feature 1..819: note = Ceres Annot ID no. 1443040
  misc_feature 1..819: note = Encodes the peptide sequence at SEQ ID NO. 760
  source 1..819: mol_type = other DNA
atgtcattctcttgtcccagatcctcaaaaggtggcaatttcttccaagattttgacatcacctggggcgatcaacgtgctaagatactaaacggtggccaacttctcacactatctcttgacactgcttctggttctggcttccaatccaagaatgaatacttatttggccgaatcgacatgcaaatcaagctaataccaggcaactcggctggtactgtcactacatactatctatcgtctcaggggccgacccacgatgagatcgactttgagtttttgggcaatgcaactggagagccatatgttctccataccaatgtgttttcccaggggaaaggcgacagagaacaacaattctatctctggtttgatcccagtaaggcttttcacacctactccattgtgtggaacaaacaactcattattttcttagtggacaacatcccaataagagtgttccaaaacctggaatcaattggtgtggcattcccgaacaagcaagccatgaggatatattcaagtctttggaatgctgatgactgggcaacaagaggggggcttgtaaagactgattggacacaagctcctttcattgcttcttacagaaatttcaaagccaatgcttgtgtttggtcacctggatcaccttgtacctccacctctcccaattctgtgcaagacaatgcctggcaagttcaagcacttgatgccccggggcgcaacagacttcgatgggtgcagcagaagtacatgatttacaactactgcactgacttgaaacggttccctcagggtctcccacctgaatgcaagtga

SEQ ID NO: 760 - protein, 272 aa, Populus trichocarpa
  REGION 1..272: note = Ceres Annot ID no. 1443040
  REGION 14..195: note = Pfam Name: Glyco_hydro_16 Pfam Description: Glycosyl hydrolases family 16
  REGION 218..271: note = Pfam Name: XET_C Pfam Description: Xyloglucan endo-transglycosylase (XET)
  REGION 1..272: note = Bit score of 578.6 for HMM based on sequences of Figure 11
  REGION 1..272: note = Functional Homolog Of SEQ ID NO. 641
MSFSCPRSSKGGNFFQDFDITWGDQRAKILNGGQLLTLSLDTASGSGFQSKNEYLFGRIDMQIKLIPGNSAGTVTTYYLSSQGPTHDEIDFEFLGNATGEPYVLHTNVFSQGKGDREQQFYLWFDPSKAFHTYSIVWNKQLIIFLVDNIPIRVFQNLESIGVAFPNKQAMRIYSSLWNADDWATRGGLVKTDWTQAPFIASYRNFKANACVWSPGSPCTSTSPNSVQDNAWQVQALDAPGRNRLRWVQQKYMIYNYCTDLKRFPQGLPPECK

SEQ ID NO: 761 - protein, 277 aa, Striga asiatica
  REGION 1..277: note = Public GI ID no. 90811697
  REGION 22..203: note = Pfam Name: Glyco_hydro_16 Pfam Description: Glycosyl hydrolases family 16
  REGION 218..274: note = Pfam Name: XET_C Pfam Description: Xyloglucan endo-transglycosylase (XET)
  REGION 1..277: note = Bit score of 612.9 for HMM based on sequences of Figure 11
  REGION 1..277: note = Functional Homolog Of SEQ ID NO. 641
MKKYIVLLALISFAATATGSNFNQDFDITWGDGRAKILNNGKLLTLSLDKTSGSGFRSKKQYMFGKIDLQIKLVPGNSAGTVTTYYLSSLGPNHDEIDFEFLGNLSGQPYTLHTNVFAQGKGGREQQFRLWFDPTKDFHTYSILWNPQSIIFSVDGTPIRQFKNLESKGVPYPKSQPMWVYSSLWNADDWATRGGLVKTDWSQAPFTASYTNFNALACSGATSSCSQNSSANSWFSQSLDFSGQQRIKWVQKNYMTYNYCTDTKRYPQGFPIECSIA

SEQ ID NO: 762 - DNA, 885 bp, Populus balsamifera
  misc_feature 1..885: note = Ceres Annot ID no. 1443041
  misc_feature 1..885: note = Encodes the peptide sequence at SEQ ID NO. 763
  source 1..885: mol_type = other DNA
atgtcgttcgttcgttcgagaaagctttcttcaatgcttttgtttactctgttatttgcctgtctgatgggagcctccaagggtggcaatttcttccaagattttgacatcacctggggcgatcaacgtgctaagatactaaacggtggccaacttctcacactctctctcgacaaggcttctggttctggctttcaatccaagaatgaatacttatttggccaaatcgacatgcaaatcaagctagtagcaggcaactcggctggtactgtcactgcatactatctatcttctcaagggtcgacccacgatgagattgactttgagtttttggggaatgcaactggagagccatatattctccataccaatgtgttctcccaggggaaaggcaacagagaacaacaattctatctctggtttgatcccactaaggctttccacacctactccattgtgtggaaccaacaacgcattattttcttagtggacaacatcccaataagagtgttccataatctggaatcaatcggtgtgccattcccgaacaagcaagccatgaggatacattcaagtctctggaatgctgatgattgggcaacaagaggggggcttgtaaagactgactggacacaagctcctttcactgcttcttacagaaatttcaaagccaatgcttgtatttggtcatctacatcaccttgtacctccacctctcccaattctgtgcaagacaatgcctggcaagttcaagcacttgatgccccggggcgcaacagacttcgatgggtgcaacaaaagtacatgatttacaactactgcactgacttgaagcggttccctcagggtctcccacctgaatgcaagcgatcaagatttctttga

SEQ ID NO: 763 - protein, 294 aa, Populus trichocarpa
  REGION 1..294: note = Ceres Annot ID no. 1443041
  REGION 31..212: note = Pfam Name: Glyco_hydro_16 Pfam Description: Glycosyl hydrolases family 16
  REGION 235..288: note = Pfam Name: XET_C Pfam Description: Xyloglucan endo-transglycosylase (XET)
  REGION 1..294: note = Bit score of 609.8 for HMM based on sequences of Figure 11
  REGION 1..294: note = Functional Homolog Of SEQ ID NO. 641
MSFVRSRKLSSMLLFTLLFACLMGASKGGNFFQDFDITWGDQRAKILNGGQLLTLSLDKASGSGFQSKNEYLFGQIDMQIKLVAGNSAGTVTAYYLSSQGSTHDEIDFEFLGNATGEPYILHTNVFSQGKGNREQQFYLWFDPTKAFHTYSIVWNQQRIIFLVDNIPIRVFHNLESIGVPFPNKQAMRIHSSLWNADDWATRGGLVKTDWTQAPFTASYRNFKANACIWSSTSPCTSTSPNSVQDNAWQVQALDAPGRNRLRWVQQKYMIYNYCTDLKRFPQGLPPECKRSRFL

SEQ ID NO: 764 - protein, 290 aa, Vitis vinifera
  REGION 1..290: note = Public GI ID no. 157358970
  REGION 30..211: note = Pfam Name: Glyco_hydro_16 Pfam Description: Glycosyl hydrolases family 16
  REGION 235..288: note = Pfam Name: XET_C Pfam Description: Xyloglucan endo-transglycosylase (XET)
  REGION 1..290: note = Bit score of 615.8 for HMM based on sequences of Figure 11
  REGION 1..290: note = Functional Homolog Of SEQ ID NO. 641
MAPCFSLNISSMLLFSVFVSSIMAASAGSFYQDFDLTWGDHRAKILDGEKLLTLSLDKASGSGFQSKKEYLFGKIDMQLKLVSGNSAGTVTAYYLSSQGPTHDEIDFEFLGNLSGDPYILHTNVFTQGKGNREQQFYLWFDPTENFHTYSIIWNLQNIIFLVDNIPIREFKNQESIGVPFPKSQPMRIYSSLWNADDWATRGGLVKIDWSKAPFTASYRNFNAAACLWSHGSSSCASKFTSPVSNIAWQNQGLDAKSRRKLQWVQKNYMIYNYCSDMKRFPGGLPLECRH

SEQ ID NO: 765 - protein, 287 aa, Capsicum annuum
  REGION 1..287: note = Public GI ID no. 90656516
  REGION 21..202: note = Pfam Name: Glyco_hydro_16 Pfam Description: Glycosyl hydrolases family 16
  REGION 228..282: note = Pfam Name: XET_C Pfam Description: Xyloglucan endo-transglycosylase (XET)
  REGION 1..287: note = Bit score of 566.4 for HMM based on sequences of Figure 11
  REGION 1..287: note = Functional Homolog Of SEQ ID NO. 641
MLLQLSILAVLLLYPVWADNFYQDTTVTFGDQRAQIQDGGRILALSLDKISGSGFQSKNEYLFGRFDMQLKLVPGNSAGTVTTFYLSSQGAGHDEIDFEFLGNSSGQPYTVHTNVYSQGKGNKEQQFRLWFDPTSSFHTYSIVWNSQRIIFLVDNIPIRVFNNHEAIGVAFPKNQAMRVYASLWNADDWATQGGRVKTDWSMAPFTAAYRNFNTNACVWSAATSTSSCGGSKTDSVNNAQTWQTQELNASERNRLRWVQQKYMIYNYCADAKRFSQGFSPECKRSRF

SEQ ID NO: 766 - protein, 289 aa, Solanum lycopersicum
  REGION 1..289: note = Public GI ID no. 577066
  REGION 23..204: note = Pfam Name: Glyco_hydro_16 Pfam Description: Glycosyl hydrolases family 16
  REGION 230..284: note = Pfam Name: XET_C Pfam Description: Xyloglucan endo-transglycosylase (XET)
  REGION 1..289: note = Bit score of 573.0 for HMM based on sequences of Figure 11
  REGION 1..289: note = Functional Homolog Of SEQ ID NO. 641
MLLQQLSVLALLLLLCPVWADNFYQDATVTFGDQRAQIQDGGRLLALSLDKISGSGFQSKNEYLFGRFDMQLKLVPGNSAGTVTTFYLSSQGAGHDEIDFEFLGNSSGQPYTVHTNVYSQGKGNKEQQFRLWFDPTSPFHTYSIVWNSQRIIFLVDNIPIRVFNNHEKLGVAFPKNQAMRVYASLWNADDWATQGGRVKTDWSMAPFTASYRNFNTNACVWSAASSTSSCGGSKTDSVNNDQAWQTQELNGNDRNRLRWVQQKYMIYNYCADAKRFSQGLSPECKRSRF

SEQ ID NO: 767 - protein, 287 aa, Capsicum annuum
  REGION 1..287: note = Public GI ID no. 90656520
  REGION 21..202: note = Pfam Name: Glyco_hydro_16 Pfam Description: Glycosyl hydrolases family 16
  REGION 228..282: note = Pfam Name: XET_C Pfam Description: Xyloglucan endo-transglycosylase (XET)
  REGION 1..287: note = Bit score of 563.9 for HMM based on sequences of Figure 11
  REGION 1..287: note = Functional Homolog Of SEQ ID NO. 641
MLLQLSILAVLLLCPVWAENFYQDATVTFGDHRAQIQDGGRVLALSLDKISGSGFQSKNEYLFGRFDMQLKLVPGNSAGTVTTFYLSSQGAGHDEIDFEFLGNSSGQPYTVHTNVYSQGKGNKEQQFRLWFDPTSSFHTYSIVWNSQRIIFLVDDIPIRVFNNHEALGVAFPKNQAMRVYASLWNADDWATQGGWVKTDWSMAPFTASYRNFNTNACVWSAATSTSSCGGSKTDSVNNVQTWQTQELNASERNRLRWVQQKYMIYNYCTDAKRFSQGFSPECKRSRF

SEQ ID NO: 768 - protein, 287 aa, Solanum tuberosum
  REGION 1..287: note = Public GI ID no. 88683124
  REGION 21..202: note = Pfam Name: Glyco_hydro_16 Pfam Description: Glycosyl hydrolases family 16
  REGION 228..282: note = Pfam Name: XET_C Pfam Description: Xyloglucan endo-transglycosylase (XET)
  REGION 1..287: note = Bit score of 563.4 for HMM based on sequences of Figure 11
  REGION 1..287: note = Functional Homolog Of SEQ ID NO. 641
MLLQLSLLALVLLSPVWADNFYQDATVTFGDQRAQIQDGGRLLALSLDKISGSGFQSKNEYLFGRFDMQLKLVPGNSAGTVTTFLLSSQGAGHDEIDFEFLGNSSGKPYTVHTNVYSQGKGNKEQQFRLWFDPTSSFHTYSIVWNSQRIIFLVDNIPIRVFNNHEALGVAFPKNQAMRVYASLWNADDWATQGGRVKTDWSMAPFTASYRNFNTNACVWSAATSTSSCGGSKTESVNNDQTWQSQQLNANGRNRVRWVQQKYMIYNYCADANRFSQGFSPECKRSRF

SEQ ID NO: 769 - protein, 288 aa, Capsicum annuum
  REGION 1..288: note = Public GI ID no. 90656518
  REGION 22..203: note = Pfam Name: Glyco_hydro_16 Pfam Description: Glycosyl hydrolases family 16
  REGION 229..283: note = Pfam Name: XET_C Pfam Description: Xyloglucan endo-transglycosylase (XET)
  REGION 1..288: note = Bit score of 565.4 for HMM based on sequences of Figure 11
  REGION 1..288: note = Functional Homolog Of SEQ ID NO. 641
MLLHLSILALLLLCPAAWAENFYQDATVTFGDQRAQIQDGGRVFALSLDKISGSGFQSKNEYLFGRFDMQLKLVPGNSAGTVTTFYLSSQGAGHDEIDFEFLGNSSGQPYTVHTNVYSQGKGNKEQQFRLWFDPTSSFHTYSIVWNSQRIIFLVDNIPIRVYNNDEAIGVPFPKNQAMRVYASLWNADDWATQGGRVKTDWSMAPFTASYRNFNTNACVWSAASSTSSCGGSKTDSVNNAQTWQTQELNANERNRLRWVQQKYMIYNYCADAKRFSQGFSPECKRSRF

SEQ ID NO: 770 - DNA, 864 bp, Populus balsamifera
  misc_feature 1..864: note = Ceres Annot ID no. 1482565
  misc_feature 1..864: note = Encodes the peptide sequence at SEQ ID NO. 771
  source 1..864: mol_type = other DNA
atgaaagcagggctgctagtctctctgatagtaaactttctggtggttgcttctgccggcagcttctacaatgatttttatttcaactggggacatgaccacggtaaggtatacgacaatggcaatggtctgagcctcattcttgacaaaaattctggatcagggtttcaatccaagaaagagtatttatttggtaagattgatatccagctcaagcttgtccatggcaattcggccggcactgtcactacattttatctatcctctctagggccataccacgatgagatagacttcgaattcttgggaaatacaagtggtcagccatacactcttcacactaacgtgttcagccaaggcaaaggtaacagagagcagcaattctatctttggtttgaccccactgctgatttccacacgtattctatcctttggaatccacaacgcataattttttcagttgatggcattgcaattagagaattcaagaacttagaatccattggcgttccattccctaagaaccaaccaatgaggatttactccagtctttgggaagctgatgactgggcaacatgtggtggaagagttaagacagattggacaaaagcacccttcgttgcttcgtttaggaacttcaacgtcaatgcctgtgcttggtcttacggagcatcttcttgtaaatcaaaatctggctttgctgactccatcagcaactcatggatctgggaagagctcgatgtcggacgcgaaggccagatgaaatgggtgcgggacaattacatgacctatgactattgcaaagattccaagcgattcccacacggcctccctcgtgagtgctatgtcaccaactttccctga

SEQ ID NO: 771 - protein, 287 aa, Populus trichocarpa
  REGION 1..287: note = Ceres Annot ID no. 1482565
  REGION 22..203: note = Pfam Name: Glyco_hydro_16 Pfam Description: Glycosyl hydrolases family 16
  REGION 227..281: note = Pfam Name: XET_C Pfam Description: Xyloglucan endo-transglycosylase (XET)
  REGION 1..287: note = Bit score of 577.2 for HMM based on sequences of Figure 11
  REGION 1..287: note = Functional Homolog Of SEQ ID NO. 641
MKAGLLVSLIVNFLVVASAGSFYNDFYFNWGHDHGKVYDNGNGLSLILDKNSGSGFQSKKEYLFGKIDIQLKLVHGNSAGTVTTFYLSSLGPYHDEIDFEFLGNTSGQPYTLHTNVFSQGKGNREQQFYLWFDPTADFHTYSILWNPQRIIFSVDGIAIREFKNLESIGVPFPKNQPMRIYSSLWEADDWATCGGRVKTDWTKAPFVASFRNFNVNACAWSYGASSCKSKSGFADSISNSWIWEELDVGREGQMKWVRDNYMTYDYCKDSKRFPHGLPRECYVTNFP

SEQ ID NO: 772 - protein, 282 aa, Arabidopsis thaliana
  REGION 1..282: note = Public GI ID no. 15238891
  REGION 29..211: note = Pfam Name: Glyco_hydro_16 Pfam Description: Glycosyl hydrolases family 16
  REGION 235..281: note = Pfam Name: XET_C Pfam Description: Xyloglucan endo-transglycosylase (XET)
  REGION 1..282: note = Bit score of 544.2 for HMM based on sequences of Figure 11
  REGION 1..282: note = Functional Homolog Of SEQ ID NO. 641
MVSFCGRRFAFLIIFLFAAQYERVYAGSFHKDVQIHWGDGRGKILDNVGNLLSLSLDKFSGSGFQSHQEFLYGKVEVQMKLVPGNSAGTVTTFYLKSPGTTWDEIDFEFLGNISGHPYTLHTNVYTKGTGDKEQQFHLWFDPTVDFHTYCIIWNPQRVIFTIDGIPIREFKNSEALGVPFPKHQPMRLYASLWEAEHWATRGGLEKTDWSKAPFTAFYRNYNVDACVWSNGKSSCSANSSWFTQVLDFKGKNRVKWAQRKYMVYNYCTDKKRFPQGAPPECS

SEQ ID NO: 773 - DNA, 2339 bp, Panicum virgatum
  misc_feature 1..2339: note = Ceres Clone ID no. 1789981
  misc_feature 1..2339: note = Encodes the peptide sequence at SEQ ID NO. 774
  source 1..2339: mol_type = other DNA
aaagctatagtttgcatagttgaagtggatgggttccatggaagggctttctcgtacggtcatccacttcttgctccttttctgcatagtctgtaaatgtctggcatcagatttggaggcaacccagaaggcaaccctcaagattgatgcctcaccaaagcttgctcgaaaaatccctgatacactactcggagtattttttaaggagatgggccgtggtggagctggtggactatgggctgaacttgttagtaacagaggtttcgaagcaggaggccccaatactccgtcaaacattgacccatggctcattattggaaatgaatcttccatttttgtggagactgatcgtacatcatgtttcagtcgaaacattgttgctttaaggatggaggtcatctgcaataactgtccagctggtggtgttggcatttacaacccaggtttctggggcatgaacatagaagatggaaagacatacaatctagttatgtatgtgaagtcagctgaaaccgcacccttgacagtttcactaacaagctctgatgggtcgcaaaatctggcttcagtcgcgataatggttgctggcaaatcgaaatggataaaggtagagcaaaagatggttgctaaaggaaccaatagaacctcaaggcttcaaataacgtctaagaagaaaggagttgtgtggtttgaccaagtatcactcatgcctgcagacacatacaagggacatggtttccgcgacgaacttgtatccatgcttttggatttaaaaccacagttcttaagatttcctggaggttgctttgtacaaggtggctggctaagaaacgcattcaggtggagagagtctattggtccttgggaagagaggcccggacacttcggagattgttggaattattggactgatgatggccttggatattttgaatttctacagctttctgaggacctgggtgctgccccaatctgggtattcaacagcggattgagctacaatgatgaagttgatacagctgctattgccccttttgtaaaggatgtactggacagcctagaatttgcaagggggagtgcaaattcatcatggggctctgttagagctgcaatgggacaccctgaaccgttccctgtcaagtatgctgcaattggaaatgaagactgtgggaagaagttttacaatggtaattacctcaagttttacaatgctataagagaggcatatccagacattcaactgatttcaaattgtgatggctcatctggaccacttgatcatccggctgatttatatgatttccatgtctatgctgatgcaaagactctgttttccatgaagaacacatttgacaagacatcgcgttccggacccaaggcttttgtcagcgagtatgcagtttggaaaactgatgcaggtcgaggaactcttcttgcttcactggcagaagctgccttccttactgggctggagaagaatagtgatgttgttgagatggcttgccatgctccactattcgtaaatgacgatattgagaaaaagtggaacccagacgttattgtcttcaatacttggcaacattatgggactcctagttactggatgcaggtgcttttccgtgagtctagcggtgctattgttcatccaacaacgatcagttccagcagctctggtaatagttctctagcagcatctgcaattacatggcaggattcagacaatagctcattcctaagagtaaagatcataaactttgaatctgttgctgttcaaatcacaatctccacgactggacttcaggctagcattgacgtgttgcgatcgactgccactgttctcacatctagcaatgtgatggatgaaaattcttttagtaaccaagacaaggtctcgccagtcaagagccagctttttgatgcaggagcgcatatgcaagtcacactagctcctcactcattcacatcctttgatcttgcgctggctccgtctaaacttgtcacgttggcaggaagagtcaacaaatacttgatatctgaactgtgagacacccaagtgccagtaattaaggacttgccagtacggtgtaaggcaatgtgttatgcaacaccgaggagaaattaaataaaaatgtcactggaatttatatttttttatttccttgaggatgccattcaaaagtttctttagttagtgtctgatttagcacgaatattcacatctatagtcaattattgtttaaattggtaggtgatacgtccttggacattgaggcatctgtggtaatttatgttttgcgaccaaaaaaaagaatttatagttttgtggtgattttttggcg

SEQ ID NO: 774 - protein, 671 aa, Panicum virgatum
  REGION 1..671: note = Ceres Clone ID no. 1789981
  REGION 1..671: note = Ceres Seed Line no. UAC-19
  REGION 454..643: note = Pfam Name: Alpha-L-AF_C Pfam Description: Alpha-L-arabinofuranosidase C-terminus
  REGION 71..229: note = Pfam Name: CBM_4_9 Pfam Description: Carbohydrate binding domain
  REGION 1..671: note = Bit score of 1493.7 for HMM based on sequences of Figure 6
  REGION 1..671: note = Figure 6
MGSMEGLSRTVIHFLLLFCIVCKCLASDLEATQKATLKIDASPKLARKIPDTLLGVFFKEMGRGGAGGLWAELVSNRGFEAGGPNTPSNIDPWLIIGNESSIFVETDRTSCFSRNIVALRMEVICNNCPAGGVGIYNPGFWGMNIEDGKTYNLVMYVKSAETAPLTVSLTSSDGSQNLASVAIMVAGKSKWIKVEQKMVAKGTNRTSRLQITSKKKGVVWFDQVSLMPADTYKGHGFRDELVSMLLDLKPQFLRFPGGCFVQGGWLRNAFRWRESIGPWEERPGHFGDCWNYWTDDGLGYFEFLQLSEDLGAAPIWVFNSGLSYNDEVDTAAIAPFVKDVLDSLEFARGSANSSWGSVRAAMGHPEPFPVKYAAIGNEDCGKKFYNGNYLKFYNAIREAYPDIQLISNCDGSSGPLDHPADLYDFHVYADAKTLFSMKNTFDKTSRSGPKAFVSEYAVWKTDAGRGTLLASLAEAAFLTGLEKNSDVVEMACHAPLFVNDDIEKKWNPDVIVFNTWQHYGTPSYWMQVLFRESSGAIVHPTTISSSSSGNSSLAASAITWQDSDNSSFLRVKIINFESVAVQITISTTGLQASIDVLRSTATVLTSSNVMDENSFSNQDKVSPVKSQLFDAGAHMQVTLAPHSFTSFDLALAPSKLVTLAGRVNKYLISEL

SEQ ID NO: 775 - protein, 658 aa, Oryza sativa
  REGION 1..658: note = Public GI ID no. 115483997
  REGION 456..641: note = Pfam Name: Alpha-L-AF_C Pfam Description: Alpha-L-arabinofuranosidase C-terminus
  REGION 73..231: note = Pfam Name: CBM_4_9 Pfam Description: Carbohydrate binding domain
  REGION 1..658: note = Bit score of 1534.7 for HMM based on sequences of Figure 6
  REGION 1..658: note = Functional Homolog Of SEQ ID NO. 774
  REGION 1..658: note = Figure 6
  source 1..658: note = Oryza sativa subsp. japonica
MASRESFMSTIFFFLLLFSLGCKCIASELHLHATQTAVLKVDASPQLARQIPDTLFGIFFEEINHAGAGGIWAELVSNRGFEAGGPHTPSNIDPWSIIGDDSSIFVATDRTSCFSRNTVALRMEVLCDNCPAGGVGIYNPGFWGMNIEDGKIYNLVMYVKSPETVELTVSLTSSDGSQNLASTTIPVSGASNWTKLEQKLVAQGTNRTSRLQITTNKKGVVWFDQVSLMPADTYKGHGFRTELISMMLDLKPRFLRFPGGCFVEGEWLRNAFRWRESIGPWEERPGHFGDVWHYWTDDGLGYYEFLQLSEDLGAAPIWVFNNGISHNDEVDTAAIAPFVKDVLDSLEFARGNADSTWGSVRAAMGHPEPFPVKYVAIGNEDCGKKFYRGNYLKFYNAIREAYPDIQMISNCDASSSPLDHPADLYDFHVYTDSKTLFSMKNTFDRSSRNGPKAFVSEYAVWRSDAGRGSLLASLAEAAFLTGLEKNSDVVQMASYAPLFVNNNDQTWNPDAIVFNSWQQYGTPSYWMQTLFGESSGAMFHPVTITSSYSGSLAASAITWQDSENSFLRVKIINFGSDPVSLTISATGLQARVNALGSTATVLTSSNVMDENSFSNPNKVVPVKSQLSNAAEQMQVTLAPHSFSSFDLALAQSKLVAEM

SEQ ID NO: 776 - protein, 656 aa, Hordeum vulgare
  REGION 1..656: note = Public GI ID no. 13398414
  REGION 454..639: note = Pfam Name: Alpha-L-AF_C Pfam Description: Alpha-L-arabinofuranosidase C-terminus
  REGION 71..229: note = Pfam Name: CBM_4_9 Pfam Description: Carbohydrate binding domain
  REGION 1..656: note = Bit score of 1521.0 for HMM based on sequences of Figure 6
  REGION 1..656: note = Functional Homolog Of SEQ ID NO. 774
  REGION 1..656: note = Figure 6
MGSRQVFVPTIACVLLLFCFGCKCIASELQATQTATLKVDASSQLARKIPDTLFGMFFEEINHAGAGGIWAELVSNRGFEAGGLHTPSNIDPWSIIGDDSSIFVATDRTSCFSRNIIALRMEVLCDDCPASGVGIYNPGFWGMNIEDGKTYNLVMYVKSAEAAELTVSLASSDGLQNLASVTVPVAGTSNWTKVEQKLIAKGTNRTSRLQITSNKKGVVWFDQVSLMPSDTFKGHGFRTELISMLLDLKPRFLRFPGGCFVEGEWLRNAFRWRESIGPWEERPGHFGDVWHYWTDDGLGYYEFLQLSEDLGAAPIWVFNNGISHNDEVSTAAIAPFVKDVLDSLEFARGSANSTWGSVRAAMGHPEPFPVKYVAIGNEDCGKKYYLGNYLKFYNAIRESYPDIQMISNCDGSSKPLDHPADLYDFHVYTDSKTLFNMKGTFDKTSRTGPKAFVSEYAVWRTDAGRGSLLGSLAEAAFLTGLEKNSDIVHMASYAPLFVNDNDQTWNPDAIVFNSWQQYGTPSYWMQKFFRESSGAMIHPITISSSYSGSLAASAITWQDSGNNFLRVKIVNFGSDTVSLTISVSGLQASINALGSNATVLTSSNVKDENSFSNPTKVVPVTSQLHNAAEQMQVTLAAHSFSSFDLALAQSELVAEM

SEQ ID NO: 777 - protein, 675 aa, unidentified
  REGION 1..675: note = Public GI ID no. 33151175
  REGION 460..648: note = Pfam Name: Alpha-L-AF_C Pfam Description: Alpha-L-arabinofuranosidase C-terminus
  REGION 70..235: note = Pfam Name: CBM_4_9 Pfam Description: Carbohydrate binding domain
  REGION 1..675: note = Bit score of 1647.4 for HMM based on sequences of Figure 6
  REGION 1..675: note = Functional Homolog Of SEQ ID NO. 774
  REGION 1..675: note = Figure 6
  source 1..675: note = Malus x domestica
MGSCKSPHVVLLLHVLLCSVYRCFAIGVDANQTANLLIDASQASARPISDTLFGIFFEEINHAGAGGVWAELVSNRGFEAGGPNTPSNIDPWAIIGNESSLIVSTDRSSCFDRNKVALRMEVLCDTQGANSCPAGGVGIYNPGFWGMNIEKGKTYNAVLYVRSSGSINVSVSLTGSDGLQKLAAANIIASGSEVSNWTKFEVQLKAQGTNPNSRLQLTTTSKGVIWFDQVSAIPLDTYKGHGFRKDLVQMLADLKPRFFRFPGGCFVEGEWLRNAFRWKETIGPWEERPGHFGDVWMYWTDDGLGYFEFLQLSEDLGSLPIWVFNNGISHNDQVDTSSVLPFVQEALDGIEFARGSPNSTWGSLRAAMGHPEPFDLRYVAIGNEDCGKKNYRGNYLKFYSAIRNAYPDIKMISNCDGSSRQLDHPADMYDFHIYTSASNLFSMANHFDHTSRNGPKAFVSEYAVTGKDAGRGSLLAALAEAGFLIGLEKNSDIVEMASYAPLFVNTHDRRWNPDAIVFDSSQLYGTPSYWVQCLFNESSGATLYNSTLQMNSSTSLLASAISWQNSENENTYLRIKVVNLGTYTVNLKVFVDGLEPNSVSLSGSTKTVLTSNNQMDENSFNEPKKVIPKRSLLESAGEEMEVVISPRSFTSIDLLMESSDVIRTTGADSVSVSSI

SEQ ID NO: 778 - protein, 675 aa, Pyrus communis
  REGION 1..675: note = Public GI ID no. 119507455
  REGION 460..648: note = Pfam Name: Alpha-L-AF_C Pfam Description: Alpha-L-arabinofuranosidase C-terminus
  REGION 70..235: note = Pfam Name: CBM_4_9 Pfam Description: Carbohydrate binding domain
  REGION 1..675: note = Bit score of 1644.2 for HMM based on sequences of Figure 6
  REGION 1..675: note = Functional Homolog Of SEQ ID NO. 774
  REGION 1..675: note = Figure 6
MGSCKSPHIVLLLYVLLCSVYRCFAIGVDANQTANLLIDASQASARPISDTLFGIFFEEINHAGAGGVWAELVSNRGFEAGGPNTPSNIDPWAIIGNESFLIVSTDRSSCFDRNKVALRMEVLCDTQGANSCPAGGVGIYNPGFWGMNIEKGKTYNTVLYVRSSGSINVSVSLTGSDGLQKLAAANIIASGSEVSNWTKFEVQLIAQGTNPNSRLQLTTTSKGVIWFDQVSAIPLDTYKGHGFRKDLVQMLADLKPQFFRFPGGCFVEGEWLRNAFRWKETIGPWEERPGHFGDVWMYWTDDGLGYFEFLQLSEDLGSLPIWVFNNGISHNDQVDTSSVLPFVQEALDGIEFARGSPNSTWGSLRAAMGHPEPFDLRYVAIGNEDCGKKNYRGNYLKFFSAIRNAYPDIKMISNCDGSSRQLDHPADMYDFHIYTSASNLFSMANHFDHTSRNGPKAFVSEYAVTGKDAGRGSLLAALAEAGFLIGLEKNSDIVEMASYAPLFVNTHDRRWNPDAIVFDSSQLYGTPSYWVQCLFNESSGATLYNSTLQMNSSTSLLASAISWQNSENENTYLRIKVVNLGTNTVNLQVFVDGLEPNSISLSGSTKTVLTSNNQMDENSFNDPTKVIPKQSLLESAGEEMEVVISPRSFTSIDLLMESSDIIRTTGADSVSVSSI

SEQ ID NO: 779 - DNA, 2106 bp, Glycine max
  misc_feature 1..2106: note = Ceres Clone ID no. 549408
  misc_feature 1..2106: note = Encodes the peptide sequence at SEQ ID NO. 780
  source 1..2106: mol_type = other DNA
gaccttgtgttgtttcagattgcatttgcagatagattgaatgttgtgaacaaacaatgggttcatccaaggccttatgcagtgtttctctgctccatttgttcatagtggtttgccttgtcttccaatgctttgctactaaaaaccatgctgacctgaccacaactctaactgtgaatgcttctgatgcatctggaaagccaataccagagacactttttggcatattctttgaggagattaatcatgctggagctgggggattgtgggctgagcttgtgagcaacagaggatttgaagctggcggtcctaacactccttcaaatattgatccttggtcaattattggaaatgaatcattgataaatgttgaaactgatcgtacctcttgctttgaccgtaataaggttgcacttcgattggaggtatcatgtgacagcgaaggtgacaacatctgcccagctgatggtgttggtgtttataatcctggtttctggggcatgaatattgagcaagggaagaaatacaaagtggtcttctatgttcgttcaactgaatcacttaatctaacagtttcattgactggatccaatggtgtaggaaacctggcttcatctgtgatcacaggttctgcacttgatttttcaaactggacaaaggtggagaagatactggttgccaaggcaacagataataactcaagacttcaattaacaaccaccaccaaaggtgtgatatggttggaccaagtgtctgctatgccactggacacatataagggacatggtttccgaactgaccttgttgaaatgctgacagctttgaaaccaagatttatcagatttccgggcggttgttttgttgaaggagaatggttaagaaatgcatttcgatggaaaacatccattggaccatgggaggagagacctgggcactttggtgatgtttggatgtactggactgatgatggacttggttattatgagtttctccaacttgcagaggacttgggtgcttcaccaatatgggtatttaataatggtgtcagtcataatgatcaagttgatacatcggcggtcttacctcttgtgcaagaagcccttgatggaattgagttcgcgagaggtgatcccacttcaaaatggggttcccttagagctgctatgggacatcctgagccatttgacctcagatatgttgctgttgggaatgaagattgtggaaaaaagaattatcgaggaaactacctgaaattctatagtgcaataaaaagtgcttatccagatatccaaattatctcaaactgtgatggttcttctcgacctttagatcatccagctgatatgtatgattatcatgtttatacaaatgcgaatgacatgttttatagagctaacacatttgatcatacatcacgaaatggtccaaaggcttttgtaagtgagtatgccgtgactggaaaagatgctgggacaggaagcctcttggcagccctagctgaagctggcttcctaattggactggaaaagaacagtgatgttatccaaatggccagctatgctccactttttgttaatgccaatgataggaggtggaacctggatgcaattgtattcaactcctttcagctctatggaactcctagctattgggtgcaactatttttctcagagtcaagtggagcaacacttctaagtacatcacttcaagcaccttcctcaaattcacttgttgcatcagcaattacatttcaaaattctgtagataagaaaaattacatacgaataaaggttgtgaacttcggtaccactgccgtgaacctcaaaatctctcttgatggactggaaccaaactcattgcagttatctgggtcaacaaagactgtgcttacatctgcaaatgtaatggatgagaactccttctcacagccaaagaaggtggtgccaatccaaagtctacttcagaatgttgagaaggacatgaatgtcacagtcccacctcgttcgttcacatcatttgatctgctgaaacaatccagtaatttgaagatggcagggagcgattcttccacgtggtcttctatttaacgttattaaaaatttgacc

SEQ ID NO: 780 - protein, 676 aa, Glycine max
  REGION 1..676: note = Ceres Clone ID no. 549408
  REGION 462..650: note = Pfam Name: Alpha-L-AF_C Pfam Description: Alpha-L-arabinofuranosidase C-terminus
  REGION 72..237: note = Pfam Name: CBM_4_9 Pfam Description: Carbohydrate binding domain
  REGION 1..676: note = Bit score of 1613.7 for HMM based on sequences of Figure 6
  REGION 1..676: note = Functional Homolog Of SEQ ID NO. 774
  REGION 1..676: note = Figure 6
MGSSKALCSVSLLHLFIVVCLVFQCFATKNHADLTTTLTVNASDASGKPIPETLFGIFFEEINHAGAGGLWAELVSNRGFEAGGPNTPSNIDPWSIIGNESLINVETDRTSCFDRNKVALRLEVSCDSEGDNICPADGVGVYNPGFWGMNIEQGKKYKVVFYVRSTESLNLTVSLTGSNGVGNLASSVITGSALDFSNWTKVEKILVAKATDNNSRLQLTTTTKGVIWLDQVSAMPLDTYKGHGFRTDLVEMLTALKPRFIRFPGGCFVEGEWLRNAFRWKTSIGPWEERPGHFGDVWMYWTDDGLGYYEFLQLAEDLGASPIWVFNNGVSHNDQVDTSAVLPLVQEALDGIEFARGDPTSKWGSLRAAMGHPEPFDLRYVAVGNEDCGKKNYRGNYLKFYSAIKSAYPDIQIISNCDGSSRPLDHPADMYDYHVYTNANDMFYRANTFDHTSRNGPKAFVSEYAVTGKDAGTGSLLAALAEAGFLIGLEKNSDVIQMASYAPLFVNANDRRWNLDAIVFNSFQLYGTPSYWVQLFFSESSGATLLSTSLQAPSSNSLVASAITFQNSVDKKNYIRIKVVNFGTTAVNLKISLDGLEPNSLQLSGSTKTVLTSANVMDENSFSQPKKVVPIQSLLQNVEKDMNVTVPPRSFTSFDLLKQSSNLKMAGSDSSTWSSI

SEQ ID NO: 781 - protein, 674 aa, Pyrus pyrifolia
  REGION 1..674: note = Public GI ID no. 37777015
  REGION 460..647: note = Pfam Name: Alpha-L-AF_C Pfam Description: Alpha-L-arabinofuranosidase C-terminus
  REGION 70..235: note = Pfam Name: CBM_4_9 Pfam Description: Carbohydrate binding domain
  REGION 1..674: note = Bit score of 1610.0 for HMM based on sequences of Figure 6
  REGION 1..674: note = Functional Homolog Of SEQ ID NO. 774
  REGION 1..674: note = Figure 6
MGSCKSPHIVLLLYVLLCSVYRCFAIGVDANQTANLLIDASQASARPISDTLFGIFFEEINHAGAGGVWAELVSNRGFEAGGPNTPSNIDPWAIIGNESFLIVSTDRSSCFDRNKVALRMEVLCDTQGANSCPAGGVGIYNPGFWGMNIEKGKTYNAVLYVRSSGSINVSVSLTGSDGLQKLAAANIIASGSEVSNWTKFEVQLEAQGTNPNSRLQLTTTSKGVIWFDQVSAIPLDTYKGHGFRKDLVQMLADLKPRFFRFPGGCFVEGEWLRNAFRWKETIGPWEERPGHFGDVWKYWTDDGLGYFEFLQLSEDLGSLPIWVFNNGISHNDQVDTSSVLPFVQEALDGIEFARGSPNSTWGSLRAAMGHPEPFDLRYVAIGNEDCGKKNYRGNYLKFFSAIRNAYPDIKMISNCDGSSRQLDHPADMYDFHIYTSASNLFSMANHFDHTSRNGPKAFVSEYAVTGKDAGRGSLLAALAEAGFLIGLEKNSDIVESGHLRPPLRQHDRRWNPDAIVFDSSQLYGTPSYWVQCLFNESSGATLYNSTLQMNSSTPLLASAISWQNSENENTYLRIKVVNLGTDTVNLKVFVDGLDPNSISLSGSTKTVLTSNNQMDENSFNEPTKVIPKQSLLESASEEMEVVISPRSFTSIDLLMESSDIIRTTGADSVSVSSI

SEQ ID NO: 782 - protein, 677 aa, Prunus persica
  REGION 1..677: note = Public GI ID no. 157313302
  REGION 460..651: note = Pfam Name: Alpha-L-AF_C Pfam Description: Alpha-L-arabinofuranosidase C-terminus
  REGION 70..235: note = Pfam Name: CBM_4_9 Pfam Description: Carbohydrate binding domain
  REGION 1..677: note = Bit score of 1641.2 for HMM based on sequences of Figure 6
  REGION 1..677: note = Functional Homolog Of SEQ ID NO. 774
  REGION 1..677: note = Figure 6
MGSRKSPHVVLLLYVLVCFVYQSFAIGVDTNQTAKLLVDASEASGRPISETLFGIFFEEINHAGAGGLWAELVSNRGFEAGGPNVPSNIDPWSIIGNESSLIVSTDRSSCFDRNKVALRIEVLCDSQGASSCPDGGVGIYNPGFWGMNIEKGKTYSVVLYVRSSGSINVSVSLTGSDGLQKLAAANIIASDSEVSNWTKVEVMLEAQGTNPNSRLQLTTTRKGFIWFDQVSVMPLDTYKGHGFRKDLVEMLEDLKPQFIRFPGGCFVEGEWLRNAFRWKETIGPWEERPGHFGDVWMYWTDDGIGYFEFLQLAEDLGTLPIWVFNNGISHTDQVDTSSVLPFVQEALDGLEFARGSPNSTWGCLRAAMGHPEPFDLRYVAIGNEDCGKKNYRGNYLKFYSAIKRAYPDIKIISNCDGSSRKLDHPADLYDFHVYTDAKNMFSMAHQFDHTSRSGPKAFVSEYAVTGKDAGTGSLLAALGEAGFLIGLEKNSDVVEMASYAPLFVNANNRRWNPDAIVFNSSHLYGTPSYWVQCLFNESSGATIFNATLQTNLSTSLLASAISWKNSENGNSYLRIKIVNFGTNIVNLKIVVDGLEPNSINLSESTKTVLTSTNLMDENSFNEPKKVIPNRILLEKAGEDGEDMEVAISPHSFTSIDFLIESSFIRTTGADSVSVSSI

SEQ ID NO: 783 - protein, 665 aa, Fragaria X ananassa
  REGION 1..665: note = Public GI ID no. 157072586
  REGION 452..640: note = Pfam Name: Alpha-L-AF_C Pfam Description: Alpha-L-arabinofuranosidase C-terminus
  REGION 62..227: note = Pfam Name: CBM_4_9 Pfam Description: Carbohydrate binding domain
  REGION 1..665: note = Bit score of 1594.6 for HMM based on sequences of Figure 6
  REGION 1..665: note = Functional Homolog Of SEQ ID NO. 774
  REGION 1..665: note = Figure 6
MGVLDVLLCCCCCLVLPCFAVEAQTAQLIVDASQASGRPISPTLFGLFFEEINHAGAGGLWAELVNNRGFEAGGPNTPSNIDPWSIIGSESSLLVSTDRSSCFERNKVALRMEVLCDSQGANICPAGGVGIYNPGFWGMNVEKGKTYSVTLYVRSSGAINVSVSLTSSNGLQTLAAENIMASVSEVSNWTKFNVLLVAKGTNPSSRLQLTTARKGLIWFDQVSAMPLDTYKGHGFRKDLVDMLADMKPQFLRFPGGCFVEGEWLRNAFRWKETIGQWEERPGHFGDVWMYWTDDGLGYFEFLQLAEDLGTRPIWVFNNGISHNDQVDTSNILPFVQEALDGIEFATGSPDSTWGSIRAAMGHPEPFDLRYVAVGNEDCGKKNYRGNYLKFYSAIKHAYPDIQIISNCDGSSHPLDHPADLYDFHVYTSASNMFSMAHQFDRTPRKGPKAFVSEYAVTGKDAGGGSLLAALAEAGFLIGLEKNSDVVEMASYAPLFVNANNKRWSPDAIVFNSSQLYGTPSYWVQCFFSESSGATIFNATLQTESSTSLLASAILWKSSEDQKTYLRIKIVNFGSNIVNLRIRVDGLEPNSVSMSGSTKTVLTSKNVMDENSFDEPKKVIPNLGLLENAGEEMDVGLSAHSFTSIDLLVEPSHLTTGADSSSISSS

SEQ ID NO: 784 - DNA, 2013 bp, Populus balsamifera
  misc_feature 1..2013: note = Ceres Annot ID no. 1506572
  misc_feature 1..2013: note = Encodes the peptide sequence at SEQ ID NO. 785
  source 1..2013: mol_type = other DNA
atgggttattggaaggcctcctgcagtgttcttctggtctgcttctttgttggtctttgttccgtgtatcaatgctctgctgctgaagttgatgcatatcagacagcaaaattgatcgttaatgcctccagtggtcggcctattcctgaaacactctttggaattttcttcgaggagataaaccatgccggagctggtgggatatgggcagagcttgtaagcaatcggggttttgaagctgggggccaaaatactccctcaaatattgctccctggtctataattggtgatcagtcatctttaactgtatctactgatcgttcttcttgctttgagcgcaataaggttgcactccgaatgcatgtgctctgtgacagcgagggcagtaatatttgcccagctggcggagttggaatatataatccagggttttggggcatgaatattgaacaagggaagatctacaaagtagttctttatgttcgttctcttggatcaatcaatgtatctgtatcattgacgagctcagatgggctgcagatattggcgactgctaacattgtagattctgatgtttcaaactggacaaagaccgaggttctattggaagccaaaggaacaaatcctaattcaaggcttcagttgacaacatccaggaaaggtgtaatatggtttgatcaagtgtcagctatgcctttggagacatacaaggggcatggtttccaaaaggagctcattgaaatgcttgaagatataaaaccccaatttatcagatttcctggtggatgcttcgtcgaaggtgaatggttgagaaatgcatttcgctggaaggaaagcattggaccctgggaggagagacctgggcattttggtgatgtttggatgtattggactgatgatggacttggttactttgagtttcttcaactatctgaagatcttggtgcacggcctatatgggtgttcaacaatggaatcagccatcgggatgaagttgataccaccactgtctcaccttttgtacaagaagcccttgatggtcttgagtttgctagaggcgcttctgattctaaatggggttctgtaagagcagcaatggggcatccagagccgtttgacttgaaatatgttgctgttgggaacgaggactgttggaagaagaattaccgaggaaattatctcaagttctacgatgctataaaaagtgcctatcccgacatcaaaataatctcaaactgtgatgggtcttctcattctttggatcatcctgctgattactatgattttcatatttatacatctgccagccacctgttttctatgactcatcaatttgatcacacatcccgctctggtccaaaggcttttgtgagtgagtatgctgtgactggaaaagatgctggcacaggaagtcttttagcagcacttgctgaagctggattcctcattgggctggaaaagaacagtgatattgtggagatggcaagctacgcaccacttttcgtgaatgacaatgacaggaggtggaatccagatgcaattgtcttcaactcctcaatgcactatggaactccaagctactgggtgctgaaattcttcagagagtcgagtggagcaactctgcttgatgctaaactacaaacaaattcctcttcacttgttgcatctgcaattacctggacaaactcagtggatggtgaaacttacctgaaaataaagattgtgaattttgggaacaggcacgtgagtctcaaagtttcagttgatggattggggctcaactcacaattgtctggatcaacaaaaactgtgctcacttcttcgaatgtaatggacgagaattccttcacggatccaaacaaggtggtgccagacctcagtctgcttgagaatgctgacaaagacatgaacattataatcgctccatattctttgacttcacttgatttattaacagaatcaaacaatatcaggatgccacaaaccgattcttcagctagatcatcaatttag

SEQ ID NO: 785 - protein, 670 aa, Populus trichocarpa
  REGION 1..670: note = Ceres Annot ID no. 1506572
  REGION 458..644: note = Pfam Name: Alpha-L-AF_C Pfam Description: Alpha-L-arabinofuranosidase C-terminus
  REGION 70..233: note = Pfam Name: CBM_4_9 Pfam Description: Carbohydrate binding domain
  REGION 1..670: note = Bit score of 1612.8 for HMM based on sequences of Figure 6
  REGION 1..670: note = Functional Homolog Of SEQ ID NO. 774
  REGION 1..670: note = Figure 6
MGYWKASCSVLLVCFFVGLCSVYQCSAAEVDAYQTAKLIVNASSGRPIPETLFGIFFEEINHAGAGGIWAELVSNRGFEAGGQNTPSNIAPWSIIGDQSSLTVSTDRSSCFERNKVALRMHVLCDSEGSNICPAGGVGIYNPGFWGMNIEQGKIYKVVLYVRSLGSINVSVSLTSSDGLQILATANIVDSDVSNWTKTEVLLEAKGTNPNSRLQLTTSRKGVIWFDQVSAMPLETYKGHGFQKELIEMLEDIKPQFIRFPGGCFVEGEWLRNAFRWKESIGPWEERPGHFGDVWMYWTDDGLGYFEFLQLSEDLGARPIWVFNNGISHRDEVDTTTVSPFVQEALDGLEFARGASDSKWGSVRAAMGHPEPFDLKYVAVGNEDCWKKNYRGNYLKFYDAIKSAYPDIKIISNCDGSSHSLDHPADYYDFHIYTSASHLFSMTHQFDHTSRSGPKAFVSEYAVTGKDAGTGSLLAALAEAGFLIGLEKNSDIVEMASYAPLFVNDNDRRWNPDAIVFNSSMHYGTPSYWVLKFFRESSGATLLDAKLQTNSSSLVASAITWTNSVDGETYLKIKIVNFGNRHVSLKVSVDGLGLNSQLSGSTKTVLTSSNVMDENSFTDPNKVVPDLSLLENADKDMNIIIAPYSLTSLDLLTESNNIRMPQTDSSARSSI

SEQ ID NO: 786 - protein, 674 aa, Solanum lycopersicum
  REGION 1..674: note = Public GI ID no. 16417958
  REGION 459..648: note = Pfam Name: Alpha-L-AF_C Pfam Description: Alpha-L-arabinofuranosidase C-terminus
  REGION 71..234: note = Pfam Name: CBM_4_9 Pfam Description: Carbohydrate binding domain
  REGION 1..674: note = Bit score of 1569.5 for HMM based on sequences of Figure 6
  REGION 1..674: note = Functional Homolog Of SEQ ID NO. 774
  REGION 1..674: note = Figure 6
MESRHSIHHVLLLVLFGLSALCQCSATGVEANQTAVLLVNASEASARRIPDTLFGIFFEEINHAGAGGLWAELVNNRGFEGGGPNVPSNIDPWSIIGDESKVIVSTDRSSCFDRNKIAVQVQVLCDHTGANICPDGGVGIYNPGFWGMNIEQGKSYKLVLYVRSEESVNVSVALTGSNGLQKLAAANIVAADVSSWTKVEILLEATGTDPNSRLELRSSKKGVIWFDQVSLMPTDTYKGHGFRKDLFGMLKDLKPAFIRFPGGCFVEGDWLRNAFRWKETIGQWEERPGHFGDVWNYWTDDGLGHFEFLQLAEDLDSLPVWVFNNGVSHHDQVDTSSILPFVQEILDGLEFARGDPTSTWGSIRAKMGHPEPFDLRYVAIGNEDCGKTQYRGNYLKFYTAIKDKYPDIKIISNCDGSTRPLDHPADLYDFHIYSSASSVFSNARHFDSAPRRGPKAFVSEYAVTGNDAGKGSLLAALGEAGFLIGVEKNSEAIEMASYAPLFVNDNDRRWNPDAIVFTSSQMYGTPSYWMQHFFKESNGATLLSSSLQANPSNSLIASAITWRNSLDNNDYLRIKVVNFGTTAVITKISLTGLGQNSLETLFGAVMTELTSNNVMDENSFREPNKVIPVKTQVEKVSDNMDVVLAPRSLNSIDFLLRKSINNNVDTASVLKSSC

SEQ ID NO: 787 - DNA, 2037 bp, Arabidopsis thaliana
  misc_feature 1..2037: note = Ceres Annot ID no. 556941
  misc_feature 1..2037: note = Encodes the peptide sequence at SEQ ID NO. 788
  source 1..2037: mol_type = other DNA
atggatatggagtcttggaagttgctcagaagtgtttgtgtgctttcttttctccttggctcttgttttgtgtatcaaagccttcgtgttgttgatgctcaagaagatccaaaaccagccgtgactttgcaagtagatgcttctaatggaggtggacgacccattcctgaaacgctatttgggattttcttcgaggagatcaaccatgctggtgccggtggattatgggccgaacttgttagcaacagagggtttgaagctggtgggcaaaacacaccctctaatatttggccatggtccattgttggtgatcattcatccatatatgtagctacagaccgttcatcatgttttgaacggaataaaatcgcactgagaatggatgtgctttgtgatagcaaaggttgtccatcgggaggtgtcggagtttataaccctggttactggggcatgaatattgaagaaggaaagaagtacaaggtggctctttatgtgcgttcgactggtgatatcgatttgtctgtgtcgttgacgagctcgaatggatcacggactcttgcttctgaaaagatcatagcttctgcttctgatgtttcgaaatggattaaaaaagaggttcttttggaggcaaaagcgaccgatcctagtgcaagacttcagttaacaacaaccaagaaagggtcaatatggattgaccaagtctcggccatgccagtggatactcacaagggacatggttttagaaacgatcttttccaaatgatggccgatataaaaccccgtttcatccggttcccaggtggttgttttgtcgagggtgaatggttaagtaatgccttccgctggaaagaaaccgtaggaccttgggaagagagaccgggccattttggtgatgtttggaagtattggaccgatgatggccttggccactttgagttctttcaaatggcagaagacatcggtgcagccccgatatgggtgtttaacaacgggataagtcacaatgatgaagttgaaactgccagtatcatgccctttgttcaagaagcactcgacggtatcgagtttgcccgaggagatgccaattctacttggggatctgttcgagctaaaatgggacgccaagaaccttttgaacttaaatacgttgctattggaaatgaagattgtgggaaaacttactacagaggaaactacattgtgttctatgatgctatcaagaaagcctatccagatatcaaaatcatctccaactgcgatggatcctctcatccactcgaccacccagctgattactatgactatcacatttacacttctgctagcaatttgttttccatgtatcatcaatttgatcgcacttcacgcaaaggtccaaaggcttttgtcagtgaatatgctgttactggaaaagatgctggtacaggaagccttcttgcctctcttgcagaagctgcgtttctcattggtcttgaaaagaatagtgacattgttgaaatggcaagttatgctccactctttgtgaacacaaatgatagacggtggaaccctgatgcaatagtcttcaactcctctcatctatatggaacacctagctattgggttcaacggttttttgcagagtcaagcggagcaactcttctcacttcaacactcaagggaaactctacttctcttgttgcatctgctatctcttggaaaaacaatggcaaagattacatacgcataaaggctgtaaacttcggagctaactcagaaaatatgcaagtgttggtaactggattggacccgaacgtgatgagagtttcgggatcaaagaagacagtacttacctctaccaatgtgatggatgaaaattccttctcacagccagagaaggttgtaccacatgaaagcttgctagagttggcagaggaggatatgaccgttgttctcccgccacattccttttcttcattcgatttgttgaaggaatctgcaaagataagaatgccaatctctgattcttcttcccatcagaaaactaccactgtgtga

SEQ ID NO: 788 - protein, 678 aa, Arabidopsis thaliana
  REGION 1..678: note = Ceres Annot ID no. 556941
  REGION 464..649: note = Pfam Name: Alpha-L-AF_C Pfam Description: Alpha-L-arabinofuranosidase C-terminus
  REGION 77..239: note = Pfam Name: CBM_4_9 Pfam Description: Carbohydrate binding domain
  REGION 1..678: note = Bit score of 1560.6 for HMM based on sequences of Figure 6
  REGION 1..678: note = Functional Homolog Of SEQ ID NO. 774
  REGION 1..678: note = Figure 6
MDMESWKLLRSVCVLSFLLGSCFVYQSLRVVDAQEDPKPAVTLQVDASNGGGRPIPETLFGIFFEEINHAGAGGLWAELVSNRGFEAGGQNTPSNIWPWSIVGDHSSIYVATDRSSCFERNKIALRMDVLCDSKGCPSGGVGVYNPGYWGMNIEEGKKYKVALYVRSTGDIDLSVSLTSSNGSRTLASEKIIASASDVSKWIKKEVLLEAKATDPSARLQLTTTKKGSIWIDQVSAMPVDTHKGHGFRNDLFQMMADIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYDAIKKAYPDIKIISNCDGSSHPLDHPADYYDYHIYTSASNLFSMYHQFDRTSRKGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWKNNGKDYIRIKAVNFGANSENMQVLVTGLDPNVMRVSGSKKTVLTSTNVMDENSFSQPEKVVPHESLLELAEEDMTVVLPPHSFSSFDLLKESAKIRMPISDSSSHQKTTTV

SEQ ID NO: 789 - protein, 676 aa, Vitis vinifera
  REGION 1..676: note = Public GI ID no. 225440254
  REGION 462..650: note = Pfam Name: Alpha-L-AF_C Pfam Description: Alpha-L-arabinofuranosidase C-terminus
  REGION 70..237: note = Pfam Name: CBM_4_9 Pfam Description: Carbohydrate binding domain
  REGION 1..676: note = Bit score of 1560.7 for HMM based on sequences of Figure 6
  REGION 1..676: note = Functional Homolog Of SEQ ID NO. 774
  REGION 1..676: note = Figure 6
MGCFRASCKVLFCFFFLVSSVYQFLPIGADGNQTAQLIVDTKGPGRKMPETLFGLFFEEINHAGAGGLWAELVSNRGFEAGGPITPSNIDPWAVIGNESYVVVATDRSSPFERNKVALRVEVLCGNDSNSTNICPAGGVGVYNPGYWGMNVEQNKWFTVVMHVRSEGAVNISVALTSSNGVDTLAATNFVANACTVGNWTKYTANLRATATNSNARLQLTTTKKGVIWFDQVSLMPVDTYRNHNFRKDLSQMIADLKPRFLRFPGGCFVEGDWLRNAFRWKQTIGPWEERPGHFGDVWKYWTDDGLGYFEFLQLAEDIGALPVWVFNNGISHNDEVDTTSIGPFVQEVLDSIEFARGASNSTWGSVRTAMGHEDPFNLKYIAVGNEDCWKKNYRGNYMRFYDAIKRVYPDIKLITNCDASSRKLNHPADYYDFHIYTSATNLYSMAHQFDRTSRDAPKAFVSEYAVTGKDAGSGTLLAALAEAAFLIGVEKNSDVVEMASYAPLFVNSNDRTWSPDAIVFNSSFVYGTPSYWMQHFFSNSSGATLLNSTLTNNSSSSLIASAITWKSSQDNKTYIKLKVVNFRNVSVSLKISVDGLQTNSLQLSGATKTVLTSSNVMDENSFKEPTKVAPFRFELKDVGKDLDAELPAYSFTAFDLLTDSSSLQTVETDAGYKSSI

SEQ ID NO: 790 - DNA, 2255 bp, Panicum virgatum
  misc_feature 1..2255: note = Ceres Clone ID no. 1753603
  misc_feature 1..2255: note = Encodes the peptide sequence at SEQ ID NO. 791
  source 1..2255: mol_type = other DNA
tcctgcactcgctcgcctcttccgtcgggaggggaggtcttggatgctgcccgcatgacacacgggttcaattagagtttacaagtggaagcgtatgggtaccaaggaagcatcccctcctactgtcctctgcctcttctttctgttctgcttaggcggcaaatgcctagcgtcagaattccaagctacccagacagcaaccctcacggttgatgcctcaccgcagcttgctcggaagattcctgacacactatttgggatcttttttgaggagatcaaccatgcaggagctggtggaatatgggctgaactcgttagtaacagaggttttgaagctggaggcccccatactccatcgaacattggcccatggtccatcattggagatgactcttccatatttgtggcgactgatcgtacatcatgtttcagtcgaaacattgttgctctaaggatggaggtcctctgcgataactgtccagctgggggtgttggcatttacaacccaggattctggggcatgaacatagaagatggaaagacatacaacctagttatgtatgctaagtcgccagaaacaacagacttgacagtttcgctaacgagtgctgatgggtcacaaagtctggcttcagctacggtcacagtctctggcacattaaattggacaaaactggagcagaaattggttgccaaaggaaccaatagaacctcaaggcttcaaataacgactaacaagaaaggagttgtctggtttgatcaagtatcactcatgcctgaagacacatacaagggacacggttttcgcacagaacttatatccatgcttttggatttgaaaccacaattcttgagatttcctggaggctgctttgtagaaggtgattggttaaggaatgccttcaggtggagagaatctattggtccatgggaggagagacctggacacttcggggatgtttggcactactggactgatgatggccttggatattatgaatttcttcagcttgcggaggacctgggtgctgccccaatctgggtgttcaacaacggagtcagccacaatgatgaagttgatactgttgctattgctccttttgtaaaggatgtattggacagtctagagtttgcaagggggagtgcaaactcaacatggggctctgttagggcttcaatgggtcaccctgaacccttcccagtgaaatatgttgcaattggaaatgaagactgcgggaaaaagttttaccgtggtaactacctcaagttctacaatgctataagacaggcctatcctgacattcaaatgatctcaaactgtgatggttcatctaaaccacttgatcatcctgctgatttatacgacttccatgtctacactgactcgaagactttgtttaacatgaggagcacatttgacagaacatctcgtagtggacccaaggcttttgtgagtgagtacgctgtttggagaagtgacgcaggtagaggaagtcttcttgcttcgttggcagaagctgctttccttactgggctggagaagaatagtgacattgttcagatggcaagttatgctccactgttcgtgaacgacaatgatcaaacgtggaacccagatgctattgtctttaactcgtggcagcattatggaactccgagttactggatgcaaacccttttccgtgagtccagtggtgccatgattcatccaatcaaaatcagttccaactactctggttctctggcggcatctgcaattacttggcaagattcagagaatagtttcctaagagtaaaggttgtaaactttggatcagatgctggtagccttacaatctccacaagcggacttcaagctagtgttaatgctctgggatcaacagccactgttctcacatccgggaatgtgatggatgaaaattctttcagtaacccaaacaaggttgcgccagttaagagcgagctgagcaatgccgcagagcagatgcaggtcacgctggctcctcactccttcagttcattcgatctcgcgctggctcagtccaaacttattgcggagatgtgaagtggcatgacccatagtaggctggtgacagatacacgagcaatacacactacagatggtgtgatacgcgaataccagcaaccagggagttgctgctgttagcatcttgataaaagctttgtatagtgtaacacgatgcagatacacagtactaaataaaaatcacatcaggttggtttggtgttgactc

SEQ ID NO: 791 - protein, 656 aa, Panicum virgatum
  REGION 1..656: note = Ceres Clone ID no. 1753603
  REGION 454..639: note = Pfam Name: Alpha-L-AF_C Pfam Description: Alpha-L-arabinofuranosidase C-terminus
  REGION 71..229: note = Pfam Name: CBM_4_9 Pfam Description: Carbohydrate binding domain
  REGION 1..656: note = Bit score of 1509.4 for HMM based on sequences of Figure 6
  REGION 1..656: note = Functional Homolog Of SEQ ID NO. 774
MGTKEASPPTVLCLFFLFCLGGKCLASEFQATQTATLTVDASPQLARKIPDTLFGIFFEEINHAGAGGIWAELVSNRGFEAGGPHTPSNIGPWSIIGDDSSIFVATDRTSCFSRNIVALRMEVLCDNCPAGGVGIYNPGFWGMNIEDGKTYNLVMYAKSPETTDLTVSLTSADGSQSLASATVTVSGTLNWTKLEQKLVAKGTNRTSRLQITTNKKGVVWFDQVSLMPEDTYKGHGFRTELISMLLDLKPQFLRFPGGCFVEGDWLRNAFRWRESIGPWEERPGHFGDVWHYWTDDGLGYYEFLQLAEDLGAAPIWVFNNGVSHNDEVDTVAIAPFVKDVLDSLEFARGSANSTWGSVRASMGHPEPFPVKYVAIGNEDCGKKFYRGNYLKFYNAIRQAYPDIQMISNCDGSSKPLDHPADLYDFHVYTDSKTLFNMRSTFDRTSRSGPKAFVSEYAVWRSDAGRGSLLASLAEAAFLTGLEKNSDIVQMASYAPLFVNDNDQTWNPDAIVFNSWQHYGTPSYWMQTLFRESSGAMIHPIKISSNYSGSLAASAITWQDSENSFLRVKVVNFGSDAGSLTISTSGLQASVNALGSTATVLTSGNVMDENSFSNPNKVAPVKSELSNAAEQMQVTLAPHSFSSFDLALAQSKLIAEM

SEQ ID NO: 792 - DNA, 2249 bp, Zea mays
  misc_feature 1..2249: note = Ceres Clone ID no. 236733
  misc_feature 1..2249: note = Encodes the peptide sequence at SEQ ID NO. 793
  source 1..2249: mol_type = other DNA
atccaattcctatgccctgcacccgcagacggggagctcgcgtcttccttcggatggtggatgcatgcatgcatggtagacacgccggcccaaccagaattgacaagtggaagcgtatgggtattaccagcaacgacgcggcccctcgtgccgtcctcctccgcttcttgtttctgctctgcataggctgcaaatgcctggcatcagaggtagaggccacccagacggcgaccctcgcggtggacgcctcgccgcagcttgctcggaagatccctgatacactgttcgggatcttctttgaggagatcaaccatgcaggggctggtggcatatgggctgaacttgttagtaacagagggtttgaagctggaggcctccatactccatcaaacattgacccatggtccatcattggagacgactcctctgtatttgtggagaccgatcgcacatcatgtttcagtcgaaacatcgttgctctcaggatggaggtcctttgcgataactgtcctactggtggtgttggtgtttacaacccagggttctggggcatgaacatagaagaaggaaaggtctacaatcttgttatgtttgttaagtcaccagaaacaactgacttgacagtttcactaacaagctctaacgggttgcaaaatctggcttcagctacagtaacagtttccggcgaatcaaactggataaaagtggagcaaaagttggttgctaaaggaaccaatagaacctcaaggcttcaaataacaactaacaagaaaggagttgtctggtttgatcaagtatcactcatgcctgaagacacatacaagggacatggctttcgcacagaacttatatccatgattttggatttaaaaccacgattcttgagatttcctggaggctgctttgtagaaggtggctggttaagaaatgcctttaggtggagagaatctattggtccatgggaagagagacctggacacttcggggatgtttggcattactggactgatgatggccttggatactatgaatttcttcagcttgcggaggacctgggtactgaaccaatctgggtattcaacaatggagtcagccacaatgatgaagttgatactgttgctattgctccttttgtaaaggatgtattggacagtatagaatttgcaagggggagtgcaaattcaacatggggctctgttagggctgcaatgggccaccctgaaccattcccagtgaaatatgttgcaataggaaatgaagattgtgggaaaaaattttaccgcggtaactacctcaagttctacaatgctataagacaggcctatccagacattcaaatgatttcaaactgcgatggttcatctacaccacttgatcatcctgctgatttatacgacttccatgtctataatgattctaagactttgttcaacatgaagagcacatttgacagaacatctcgtagtggacccaaggcttttgtaagtgagtacgctgtttggagaggtgatgcaggtagaggaagtcttcttgcttcattggcagaagctgttttccttactggactggagaagaatagtgacattgtttccatggcaagttacgcgccactattcgtaaacgacaatgaccagacgtggaacccagacgcaatcgtcttcaactcctggcagcattacggcactcccagttactggatgcagacgcttttccgcgagtctagtggtgctatgttccatccaacgacaatcagctccagctactcaggttcacttgcagcgtctgcgattacctggcaggactccgagaacagcttcctaagagtaaaggtcataaacttcgggtcagatgctgtgaccctgacaatctccacaagtgggctccaggccagtatcaacgctctgggatcaaccgccactgttctcacatcagcagatgtgatggatgaaaactccttcagcaacccaaccaaggttgtgccggtaaagagcgatctgagcaatgctgcagagcagatgcaggtcacgctggctcctcgctccttcagctcgttcgatctcgccctggctcagtccaagcttgtagcggagatgtgagctaggctggtacactagtatacaatacaacgtgtgaagtgtggtacacaaataccagcaaccacaggggttgccaagctgttgttagcatcttgaacacatggctttgtattgtgtataatgacatgatgctgatactaatctctattatac

SEQ ID NO: 793 - protein, 697 aa, Zea mays
  REGION 1..697: note = Ceres Clone ID no. 236733
  REGION 495..680: note = Pfam Name: Alpha-L-AF_C Pfam Description: Alpha-L-arabinofuranosidase C-terminus
  REGION 112..270: note = Pfam Name: CBM_4_9 Pfam Description: Carbohydrate binding domain
  REGION 1..697: note = Bit score of 1500.0 for HMM based on sequences of Figure 6
  REGION 1..697: note = Functional Homolog Of SEQ ID NO. 774
PIPMPCTRRRGARVFLRMVDACMHGRHAGPTRIDKWKRMGITSNDAAPRAVLLRFLFLLCIGCKCLASEVEATQTATLAVDASPQLARKIPDTLFGIFFEEINHAGAGGIWAELVSNRGFEAGGLHTPSNIDPWSIIGDDSSVFVETDRTSCFSRNIVALRMEVLCDNCPTGGVGVYNPGFWGMNIEEGKVYNLVMFVKSPETTDLTVSLTSSNGLQNLASATVTVSGESNWIKVEQKLVAKGTNRTSRLQITTNKKGVVWFDQVSLMPEDTYKGHGFRTELISMILDLKPRFLRFPGGCFVEGGWLRNAFRWRESIGPWEERPGHFGDVWHYWTDDGLGYYEFLQLAEDLGTEPIWVFNNGVSHNDEVDTVAIAPFVKDVLDSIEFARGSANSTWGSVRAAMGHPEPFPVKYVAIGNEDCGKKFYRGNYLKFYNAIRQAYPDIQMISNCDGSSTPLDHPADLYDFHVYNDSKTLFNMKSTFDRTSRSGPKAFVSEYAVWRGDAGRGSLLASLAEAVFLTGLEKNSDIVSMASYAPLFVNDNDQTWNPDAIVFNSWQHYGTPSYWMQTLFRESSGAMFHPTTISSSYSGSLAASAITWQDSENSFLRVKVINFGSDAVTLTISTSGLQASINALGSTATVLTSADVMDENSFSNPTKVVPVKSDLSNAAEQMQVTLAPRSFSSFDLALAQSKLVAEM

SEQ ID NO: 794 - DNA, 2696 bp, Panicum virgatum
  misc_feature 1..2696: note = Ceres Clone ID no. 1786359
  misc_feature 1..2696: note = Encodes the peptide sequence at SEQ ID NO. 795
  source 1..2696: mol_type = other DNA
acaaggtacaccaacccaaagatgcggccacagccagatcaagtcgttccatgacgacggccttggctcgctccatgattagtactccggcagtaatgcttgataattaaggaaaaaataaattaaaaatccaaatgagccggataaggcgacagtgctgttcatcgggcccacatgaccgcagccgcgcgcagccaaccgccgccgaaccaagcccgctccggcaagcaactcgccgcggcgcgtccccctgacgtccgccgtctccggcatcggatgggcgtctagaccgcggagggctccaccacactccttgcgtggcttccgtagtccggaggcacacttcccttcaaagccactgcttcgtcttcctctacttaagcgcacgccccccgggccctgccctgtactcgcgtccgggaccgggagctcgcctcttcttcctgaggaggtgttggatggtgaatgcatgacactctcattgcattagttcttacaaaggaagcctatgggtttcaaggaagtgtcatctgctacaatcttctgcctcttgcttctattctgcctgggctgcagatgcctggcatcagaactagtgacctcacaggcagcaactctcaatgttgacgcctcaccgcagtcagcccgaaagatccctgaaacactatttgggatatttttcgaggagatcaatcatgcaggagctggtggaatttgggcagagcttgttagtaacagaggtttcgaagctggaggcccacatactccctcaaatattgacccatggtccattattggagatgactcttctgtatttgtggcgactgatcgtacatcatgtttcagtcgaaacattgttgctctgaggatggaggtcctctgtgatgactgtcctactggtggtgttggtatttacaacccggggttctggggcatgaacatagaagatggaaaggcgtacaatcttgttatgtacgttaagtcaccagaaacaacagacttgactgtttcactaacaagctctgatgggttgcaaaacctggcttcaactactataacagtttctggtacatcaaattggacaaaagtggagcagaagttggttgctaatggaaccaatagaacctcaaggcttcaaataacaactaacaagaaaggagttgtttggtttgatcaagtttcactcatgcctgaagacacatacaagggacatggttttcgcacagaacttatatccatgcttttggatttgaaaccgcgattcttgagattttctggcggatgctttgtagaaggcgattggttaagaaatgcattcaggtggagagaatctattggtccatgggaaaagaggcctggacactttggggatgtttggcattactggactgatgacggcctcggatattatgaatttcttcagcttgcggaggacctgggtgctgccccaatctgggtattcaacaatggagttagccacaatgatgaagttgataccgctgctattgctccatttgtaaaggatgtattggacagtctagaatttgcaagggggagtgcagattcgacatggggctctgttagggctgcgatggggcaccctgaaccattcccagtgaaatatgttgcaattggaaatgaagattgtgggaaaaaattttaccgcggtaattacctcaagttctacaatgctataaggcaggcctatccagatattcaaatgatttcgaactgtgatggttcatctagaccacttgatcatcctgctgatttatacgacttccatgtatataccgattctaagactttgtttaacatgaggagcacattcgacagcacatctcgtagtggaccaaaggcttttgtgagtgaatacgccgtttggagaagtgatgcaggtagaggaagtcttcttgcttcattggcggaagctgctttccttactggtctggagaagaacagtgacattgttcagatggcaagttatgctccattatttgtaaacgacaatgacagaacgtggaaccctgatgctatcgtcttcaactcgtggcaacattatggaactcctagttactggatgcagacacttttccgtgagtccagcggtgctatggttcatccaattacagtcaattccagctactctggttcgctagcagcatctgcaattacttggcaggattcagagaacagcttcctaagagtaaaggttgtaaattttggatcagatgccgttagccttacaatctccacaagtggacttcaggccagtgttaatgctctgggatcaaccaccactgttctcacatccgggaatgttatggatgaaaattctttcagtaacccaaacaaggttgtgccggtgaagagcgagctgagcaatgccgcagagcagatgcaggtcacgctggctcctcactccttcagtgcgttcgatctcgcgttggctcagtccaaacttgttgcggagatgtgaagtggtatcacccttactaggctggtgacagatacacgaggaataccctacgcatggtgtgatacgcaaataacagttcttttccaaaaaaaaaaggatacgcaaataccagccaccagggagttgctgctgttagcatcttgataaagctttgtatagtgtaacacgatgcagatatactaaataaaaatcacatcatgttggtttgggttgactg

SEQ ID NO: 795 - protein, 656 aa, Panicum virgatum
  REGION 1..656: note = Ceres Clone ID no. 1786359
  REGION 454..639: note = Pfam Name: Alpha-L-AF_C Pfam Description: Alpha-L-arabinofuranosidase C-terminus
  REGION 71..229: note = Pfam Name: CBM_4_9 Pfam Description: Carbohydrate binding domain
  REGION 1..656: note = Bit score of 1516.6 for HMM based on sequences of Figure 6
  REGION 1..656: note = Functional Homolog Of SEQ ID NO. 774
MGFKEVSSATIFCLLLLFCLGCRCLASELVTSQAATLNVDASPQSARKIPETLFGIFFEEINHAGAGGIWAELVSNRGFEAGGPHTPSNIDPWSIIGDDSSVFVATDRTSCFSRNIVALRMEVLCDDCPTGGVGIYNPGFWGMNIEDGKAYNLVMYVKSPETTDLTVSLTSSDGLQNLASTTITVSGTSNWTKVEQKLVANGTNRTSRLQITTNKKGVVWFDQVSLMPEDTYKGHGFRTELISMLLDLKPRFLRFSGGCFVEGDWLRNAFRWRESIGPWEKRPGHFGDVWHYWTDDGLGYYEFLQLAEDLGAAPIWVFNNGVSHNDEVDTAAIAPFVKDVLDSLEFARGSADSTWGSVRAAMGHPEPFPVKYVAIGNEDCGKKFYRGNYLKFYNAIRQAYPDIQMISNCDGSSRPLDHPADLYDFHVYTDSKTLFNMRSTFDSTSRSGPKAFVSEYAVWRSDAGRGSLLASLAEAAFLTGLEKNSDIVQMASYAPLFVNDNDRTWNPDAIVFNSWQHYGTPSYWMQTLFRESSGAMVHPITVNSSYSGSLAASAITWQDSENSFLRVKVVNFGSDAVSLTISTSGLQASVNALGSTTTVLTSGNVMDENSFSNPNKVVPVKSELSNAAEQMQVTLAPHSFSAFDLALAQSKLVAEM

SEQ ID NO: 796 - protein, 660 aa, Oryza sativa
  REGION 1..660: note = Public GI ID no. 115487150
  REGION 458..643: note = Pfam Name: Alpha-L-AF_C Pfam Description: Alpha-L-arabinofuranosidase C-terminus
  REGION 75..233: note = Pfam Name: CBM_4_9 Pfam Description: Carbohydrate binding domain
  REGION 1..660: note = Bit score of 1521.3 for HMM based on sequences of Figure 6
  REGION 1..660: note = Functional Homolog Of SEQ ID NO. 774
  source 1..660: note = Oryza sativa subsp. japonica
MGSREPFLSAIFFFFFLLLFCLGCKCIASELHLHTTQTAVLKVDASLQHARQIPDTLFGIFFEEINHAGAGGIWAELVSNRGFEAGGPHTPSNIDPWSIIGDDSSIFVATDRTSCFSRNTVALRMEVLCDNCPAGGVGIYNPGFWGMNIEDGKTYNLVMYVKSPETVELTVSLTSSDGSQNLASSTIPVSGASNWTKLEQKLVAKGTNRTSRLQITTTKKGVVWFDQVSLMSADTYKGHGFRTELISMMLDLKPRFLRFPGGCFVEGEWLRNAFRWRESIGPWEERPGHFGDVWHYWTDDGLGYYEFLQLSEDLGAAPIWVFNNGISHNDEVDTAAIAPFVKDVLDSLEFARGSADSTWGSVRAAMGHPEPFPVKYVAIGNEDCGKKFYRGNYLKFYNAIREAYPDIQMISNCDASSRPLDHPADLYDFHVYTDSKTLFSMKSAFDRSSRNGPKAFVSEYAVWRSDAGRGSLLASLAEAAFLTGLEKNSDVVQMASYAPLFVNNNDQTWNPDAIVFNSWQQYGTPSYWMQTLFRESSGAMFHPITITSSYSGSLAASAITWQDSENSFLRVKIINFGSDPVSLTISATGLQARVNALGSTATVITSSNVMDENSFSNPNKVVPVKSQLSNAAEQMQVTLAPHSFSSFDLALAQSKLVAEM

SEQ ID NO: 797 - DNA, 1950 bp, Sorghum bicolor
  misc_feature 1..1950: note = Ceres Annot ID no. 8682811
  misc_feature 1..1950: note = Encodes the peptide sequence at SEQ ID NO. 798
  source 1..1950: mol_type = other DNA
atgggtaccggcaaggacgcagcccctcgcgccatcctctgcttcttgtttctgttctgcttaggctgcaaatgcctggcatcagagttggaggccacccagacggcgaccctcacggtcgatgcctcgccgcagcttgctcggaagatccctgatacactatttgggatcttctttgaggagatcaaccatgcaggagctggtggcatatgggctgaacttgttagtaacagagggtttgaagctggaggcctccatactccatcaaacattgacccatggtccatcattggagatgactcttctatatatgtggagactgatcggacatcatgtttcagtcgaaacatcattgctctgaggatggaggtcctttgcgataactgtcctactggtggtgttggtatttacaacccagggttctggggcatgaacatagaagatggaaaggcctacaatcttgttatgtatgttaagtcaccagaaacaaccgacttgatagtttcactaacaagctctgatgggttgcaaaatctggcttcagctacaataacagtttccggcgaatcaaattggacaaaagtggagcaaaagttggttgctaaaggaaccaatagaacctcaaggcttcaaataacaactaacaagaaaggagttgtttggtttgatcaagtatcactcatgcctgaagacacatacaagggacatggctttcgcacagaacttatatccatgattttggatttaaaaccacgattcttgagatttcctggaggttgctttgtagaaggtgagtggttaagaaatgcctttaggtggagagaatctattggtccatgggaagagagacctggacacttcggggatgtttggcattactggactgatgatggccttggatactatgaatttcttcagaaagttccctcttgtaactcaggagtcagccacaatgatgaagttgatactgctgctattgctccttttgtaaaggatgtattggacagcatagaatttgcaagggggagtgcaaattcaacatggggctctgttagggctgcaatggggcaccctgaaccattcccagtgaaatatgttgcgattggaaatgaagattgtgggaaaaaattttaccgcggtaactacctgaagttctacaatgctataagacaggcctacccagacattcaaatgatttcaaactgcgatggttcatctacaccacttgatcatcctgctgatttgtacgacttccatgtctatactgattctaagactttgttcaacatgaagagtacatttgacagaacatctcgcagtggacccaaggcttttgtgagtgagtacgctgtttggagaggtgatgcaggtagaggaagtcttcttgcttcattggcagaagctgctttccttactggactggagaagaatagtgacattgtttacatggcgagttatgcaccactgttcgtaaataacaatgaccaaacgtggaacccagacgctatcgtcttcaactcctggcagcattacggcactcctagttactggatgcagacgcttttccgtgagtctagtggtgctatgttacatccaactacaatcagctccagctactctggttcgctcgcagcgtctgcgattacctggcaggactcagagaacagcttccttagagtaaaggtcataaactttgggtcagatgctgtgaccctgacaatctccacgactggactccaggccagtatcaacgctctgggatcaaccgccactgttctcacatcagcaaacgtgatggatgaaaattccttcagtaacccaaccaaggttgtgccggtgaagagcgatatgagcaatgctgcagagcagatgcaggtcacgttggctcctcactccttcagctcgttcgatctcgccctggctcagtccaaacttgtcgccgagatgtga

SEQ ID NO: 798 - protein, 649 aa, Sorghum bicolor
  REGION 1..649: note = Ceres Annot ID no. 8682811
  REGION 447..632: note = Pfam Name: Alpha-L-AF_C Pfam Description: Alpha-L-arabinofuranosidase C-terminus
  REGION 72..230: note = Pfam Name: CBM_4_9 Pfam Description: Carbohydrate binding domain
  REGION 1..649: note = Bit score of 1459.6 for HMM based on sequences of Figure 6
  REGION 1..649: note = Functional Homolog Of SEQ ID NO. 774
MGTGKDAAPRAILCFLFLFCLGCKCLASELEATQTATLTVDASPQLARKIPDTLFGIFFEEINHAGAGGIWAELVSNRGFEAGGLHTPSNIDPWSIIGDDSSIYVETDRTSCFSRNIIALRMEVLCDNCPTGGVGIYNPGFWGMNIEDGKAYNLVMYVKSPETTDLIVSLTSSDGLQNLASATITVSGESNWTKVEQKLVAKGTNRTSRLQITTNKKGVVWFDQVSLMPEDTYKGHGFRTELISMILDLKPRFLRFPGGCFVEGEWLRNAFRWRESIGPWEERPGHFGDVWHYWTDDGLGYYEFLQKVPSCNSGVSHNDEVDTAAIAPFVKDVLDSIEFARGSANSTWGSVRAAMGHPEPFPVKYVAIGNEDCGKKFYRGNYLKFYNAIRQAYPDIQMISNCDGSSTPLDHPADLYDFHVYTDSKTLFNMKSTFDRTSRSGPKAFVSEYAVWRGDAGRGSLLASLAEAAFLTGLEKNSDIVYMASYAPLFVNNNDQTWNPDAIVFNSWQHYGTPSYWMQTLFRESSGAMLHPTTISSSYSGSLAASAITWQDSENSFLRVKVINFGSDAVTLTISTTGLQASINALGSTATVLTSANVMDENSFSNPTKVVPVKSDMSNAAEQMQVTLAPHSFSSFDLALAQSKLVAEM

SEQ ID NO: 799 - protein, 658 aa, Hordeum vulgare
  REGION 1..658: note = Public GI ID no. 13398412
  REGION 456..641: note = Pfam Name: Alpha-L-AF_C Pfam Description: Alpha-L-arabinofuranosidase C-terminus,
  REGION 57..126: note = Pfam Name: CBM_4_9 Pfam Description: Carbohydrate binding domain
  REGION 1..658: note = Bit score of 1463.3 for HMM based on sequences of Figure 6
  REGION 1..658: note = Functional Homolog Of SEQ ID NO. 774
MGSKEMPRRTRTILCFLLLFCVSCKCLASEFEITQVASLGVDSSPHLARKIPDTLFGIFFEEINHAGAGGIWAELVSNRGFEAGGPHTPSNINPWSIIGDDSSIFVGTDRTSCFSRNKVALRMEVLCDNCPVGGVGIYNPGFWGMNIEDGKTYNLVMHVKSPETIEMTVSLTSSDGLQVLASAAIRVPGGSNWIKLDQKLVAKGTDRTSRLQITARTKGVVWLDQVSLMPSDTYKGHGFRTELISMLLDLKPRFLRFPGGCFVEGSWLRNAFRWRDSIGPWEERPGHYGDVWNYWTDDGLGYYEFLQLAEDLGAAPVWVFNNGISHHDEVDTTAIAPFVKDILDSLEFARGSAESTWGSVRAAMGHPEPFPVKYVAIGNEDCGKENYRGNYLKFYNAIREAYPDIQMISNCDGSSTPLDHPADLYDFHVYTGSSALFSMKNTFDNTSRSGPKAFVSEYAVTGNDAGRGSLLASLAEAAFLTGLEKNSDVVQMASYAPLFINDNDRTWNPDAIVFNSWQQYGTPSYWMQTLFRESSGATVHPISLSSSCSGLLAASAITWHDDENSFLRVKIVNFGPDAVGLTISATGLQGSINAFGSTATVLTSGGVMDENSFANPNKVVPVTVELRDAAEEMQVTLPPHSLTAFDLALAQSRLVADV

SEQ ID NO: 800 - protein, 654 aa, Oryza sativa
  REGION 1..654: note = Public GI ID no. 116310992
  REGION 454..639: note = Pfam Name: Alpha-L-AF_C Pfam Description: Alpha-L-arabinofuranosidase C-terminus
  REGION 71..229: note = Pfam Name: CBM_4_9 Pfam Description: Carbohydrate binding domain
  REGION 1..654: note = Bit score of 1385.7 for HMM based on sequences of Figure 6
  REGION 1..654: note = Functional Homolog Of SEQ ID NO. 774
  source 1..654: note = Oryza sativa subsp. indica
MGSKEAFRRIIFCVLLLLCVSCKCLTSEVNTTQLAVLKVDASPQHARKIPETLFGIFFEEINHAGAGGIWAELVSNRGFEAGGPNTPSSIDPWSIIGNESVISVATDRSSCFSRNIIALRMEVLCGDCQAGGVGIYNPGFWGMNIEDGKNYSLVMYAKSLENTELTVSLTSSDGLQNLSSATIQVAGTSNWTKLEQKLVAKGTNRTSRLQITTNKKGVIWLDQISLMPSDTYKGHGFRKELVSMLLDLKPQFMRFPGGCFVEGQWLRNAFRWRESVGPWEERPGHFGDVWGYWTDDGLGYYEFLQLSEDLGAAPIWVFNNGFSHNEEINTTAIAPFVKDILDSLEFARGSTNSTWGSLRVAMGHPEPFPVKYVTIGNEDCTKKFYHGNYLKFHRAIREAYPDIQIISNCDGSSKPLDHPADIYDFHVYGDSNTLFSMRNKFDSTPRNGTKAFVSEYAVSSNGVGRGTLLASLAEAAFLTGLEKNSDVVQMASYAPLFMNDNDRSWNPAAVVFNSWKQYGSPSYWMQTIFRESSGAVLHPVTINSMYSNSLAASAITWKASNSSFLRVKIVNIGSNPVNLIVSTTGLEALVNMRKSTITILTSKNLSDENSFSKPTNVVPVTRELPNAGEEMFAFLGPYSFTSFDLALGQQKHVS

SEQ ID NO: 801 - protein, 654 aa, Oryza sativa
  REGION 1..654: note = Public GI ID no. 38347003
  REGION 454..639: note = Pfam Name: Alpha-L-AF_C Pfam Description: Alpha-L-arabinofuranosidase C-terminus
  REGION 71..229: note = Pfam Name: CBM_4_9 Pfam Description: Carbohydrate binding domain
  REGION 1..654: note = Bit score of 1381.5 for HMM based on sequences of Figure 6
  REGION 1..654: note = Functional Homolog Of SEQ ID NO. 774
  source 1..654: note = Oryza sativa subsp. japonica
MGSKEAFRRIIFCVLLLLCVSCKCLTSEVNTTQLAVLKVDASPQHARKIPETLFGIFFEEINHAGAGGIWAELVSNRGFEAGGPNTPSSIDPWSIIGNESVISVATDRSSCFSRNIIALRMEVLCGDCQAGGVGIYNPGFWGMNIEDGKNYSLVMYAKSLENTELTVSLTSSDGLQNLSSATIQVAGTSNWTKLEQKLVAKGTNRTSRLQITTNKKGVIWLDQISLMPSDTYKGHGFRKELVSMLLDLKPQFMRFPGGCFVEGQWLRNAFRWRESVGPWEERPGHFGDVWGYWTDDGLGYYEFLQLSEDLGAAPIWVFNNGFSHNEEINTTAIAPFVKDILDSLEFARGSTNSTWGSLRVAMGHPEPFPVKYVTIGNEDCTKKFYHGNYLKFHRAIREAYPDIQIISNCDGSSKPLDHPADIYDFHVYGDSNTLFSMRNKFDSTPRNGTKAFVSEYAVSSNGVGRGTLLASLAEAAFLTGLEKNSDVVQMASYAPLFMNDNDLSWNPAAVVFNSWKQYGSPSYWMQTIFRESSGAVLHPVTINSMYSNSLAASAITWKASNSSFLRVKIVNIGSNPVNLIVSTTGLEALVNMRKSTITILTSKNLSDENSFSKPTNVVPVTRELPNAGEEMFAFLGPYSFTSFDLALGQQKHVS

SEQ ID NO: 802 - protein, 677 aa, Prunus persica
  REGION 1..677: note = Public GI ID no. 116739148
  REGION 460..651: note = Pfam Name: Alpha-L-AF_C Pfam Description: Alpha-L-arabinofuranosidase C-terminus
  REGION 70..235: note = Pfam Name: CBM_4_9 Pfam Description: Carbohydrate binding domain
  REGION 1..677: note = Bit score of 1622.8 for HMM based on sequences of Figure 6
  REGION 1..677: note = Functional Homolog Of SEQ ID NO. 774
MGSRKSPHVVLLLYVLVCFVYQSFAIGVDTNQTAKLLVDASEASGRPISETLFGIFFEEINHAGAGGLWAELVSNRGFEAGGPNVPSNIDPWSIIGNESSLIVSTDRSSCFDRNKVALRIEVLCDSQGASSCPDGGVGIYNPGFWGMNIEKGKTYSVVLYVRSSGSINVSVSLTGSDGLQKLAAANIIASDSEVSNWTKVEVMLEAQGTNPNSRLQLTTTRKGFIWFDQVSVMPLDTYKGHGFRKDLVEMLEDLKPQFIRFPGGCFVEGEWLRNAFRWKETIGPWEERPGHFGDVWMYWTDDGIGYFEFLQLAEDLGTLPIWVFNNGISHTDQVDTSSVLPFVQEALDGLEFARGSPNSTWGSLRAAMGHPEPFDLRYVAIGNEDCGKKNYLGNYLKFYSAIKRAYPDIKMISNCDGSSRKLDHPADLYDFHVNTDAKNMFSMAHQFDHTSRSGPKAFVSEYAVTGKDAGTGSLLAALGVAGFLIGLEKNSDVVEMACYAPLFVNANNRRWNPDAIVFNSSHLYGTPSYWVQRLFNESSGATIFNATLQTNLSTSLLASAISWKNSENGNSYLRIKIVNFGTNIVNLKIAVDGLEPNSINLSESTKTVLTSTNLMDENSFNEPKKVIPNRILLEKAGEDGEDMEVAISPRSFTTIDFLIESSFIRTTGADSVSVSSI

SEQ ID NO: 803 - protein, 664 aa, Oryza sativa
  REGION 1..664: note = Public GI ID no. 22324432
  REGION 461..648: note = Pfam Name: Alpha-L-AF_C Pfam Description: Alpha-L-arabinofuranosidase C-terminus
  REGION 71..236: note = Pfam Name: CBM_4_9 Pfam Description: Carbohydrate binding domain
  REGION 1..664: note = Bit score of 1263.0 for HMM based on sequences of Figure 6
  REGION 1..664: note = Functional Homolog Of SEQ ID NO. 774
  source 1..664: note = Oryza sativa subsp. japonica
MAVQRTDAASWLRELVLVYAMCWTVSLGFVAGQTGQLNVDASPQNARKIPDKMFGIFFEEINHAGAGGLWAELVSNRGFEAGGPNTPSNIDPWLIIGNESSIIVGTDRTSCFEKNPVALRMEVLCDSKGTNNCPSGGVGVYNPGYWGMNIERRRVYKVGLHIRSSDAVSLTVSLTSSDGLQKLASHTITASKKQFAKWTKIEFHLKSSQTNTNSRLQLTTSKSGVIWLDQVSVMPSDTYMGHGFRKDLASMLANLKPQFLKFPGGNYAMGNYLRNAFRWSETVGPWEERPGHFNDAWGYWTDDGLGFFEFLQLAEDLGASPVWVVNDGASQNEEVSTATIASLVKDVVDGIEFARGGPKTTWGSVRAAMGHPQPFNLDYVSIGNQECWMLYYRGNYQKFYSAIKAAYPDINVVSSCDKSTISPSNPADLYDVHVYTSSSDMFSRTSMFDNTTRSGPKAIVSEYAVTGKDAGKGTLVEALAEAAFLVGLERNSDVVEMASCAPLFVNDNDRRWSPDAIVFNSWQNYGCPNYWMLHFFKDSCGATFHPSNIQISSYNQLVASAITWQNSKDKSTYLKIKLVNFGNQAVNLSISVSGLDEGIKSSGSKKTVLTSSGPLDENSFQQPQKVAPVSSPVDNANEQMGVLVDPYSLTSFDLLLQPSKHSTI

SEQ ID NO: 804 - DNA, 2103 bp, Populus balsamifera
  misc_feature 1..2103: note = Ceres Annot ID no. 1453426
  misc_feature 1..2103: note = Encodes the peptide sequence at SEQ ID NO. 805
  source 1..2103: mol_type = other DNA
atgggttattggaaggcctcctgcagtgttcttctggtctgcttctttgttggtctttgttccgtgtatcaatgctctgctgctgaagttgatgcatatcagacagcaaaattgatcgttaatgcctccagtggtcggcctattcctgaaacactctttggaattttcttcgaggagataaaccatgccggagctggtgggatatgggcagagcttgtaagcaatcggggttttgaagctgggggccaaaatactccctcaaatattgctccctggtctataattggtgatcagtcatctttaactgtatctactgatcgttcttcttgctttgagcgcaataaggttgcactccgaatgcatgtgctctgtgacagcgagggcagtaatatttgcccagctggcggagttggaatatataatccagggttttggggcatgaatattgaacaagggaagatctacaaagtagttctttatgttcgttctcttggatcaatcaatgtatctgtatcattgacgagctcagatgggctgcagatattggcgactgctaacattgtagattctgatgtttcaaactggacaaagaccgaggttctattggaagccaaaggaacaaatcctaattcaaggcttcagttgacaacatccaggaaaggtgtaatatggtttgatcaagtgtcagctatgcctttggagacatacaaggggcatggtttccaaaaggagctcattgaaatgcttgaagatataaaaccccaatttatcagatttcctggtggatgcttcgtcgaaggtgaatggttgagaaatgcatttcgctggaaggaaagcattggaccctgggaggagagacctgggcattttggtgatgtttggatgtattggactgatgatggacttggttactttgagtttcttcaactatctgaagatcttggtgcacggcctatatgggtgttcaacaatgtatggaagaaggttcaggattcaccagtgttgaagctacagactcacgcacgcacgtctaatggtgctttatcagtttctaatatcatttgttttgaaagccacaacctgcttgcaggttgttcaattgttcagtcgtcaacggaagcccttgatggtcttgagtttgctagaggcgcttctgattctaaatggggttctgtaagagcagcaatggggcatccagagccgtttgacttgaaatatgttgctgttgggaacgaggactgttggaagaagaattaccgaggaaattatctcaagttctacgatgctataaaaagtgcctatcccgacatcaaaataatctcaaactgtgatgggtcttctcattctttggatcatcctgctgattactatgattttcatatttatacatctgccagccacctgttttctatgactcatcaatttgatcacacatcccgctctggtccaaaggcttttgtgagtgagtatgctgtgactggaaaagatgctggcacaggaagtcttttagcagcacttgctgaagctggattcctcattgggctggaaaagaacagtgatattgtggagatggcaagctacgcaccacttttcgtgaatgacaatgacaggaggtggaatccagatgcaattgtcttcaactcctcaatgcactatggaactccaagctactgggtgctgaaattcttcagagagtcgagtggagcaactctgcttgatgctaaactacaaacaaattcctcttcacttgttgcatctgcaattacctggacaaactcagtggatggtgaaacttacctgaaaataaagattgtgaattttgggaacaggcacgtgagtctcaaagtttcagttgatggattggggctcaactcacaattgtctggatcaacaaaaactgtgctcacttcttcgaatgtaatggacgagaattccttcacggatccaaacaaggtggtgccagacctcagtctgcttgagaatgctgacaaagacatgaacattataatcgctccatattctttgacttcacttgatttattaacagaatcaaacaatatcaggatgccacaaaccgattcttcagctagatcatcaatttag

SEQ ID NO: 805 - protein, 700 aa, Populus trichocarpa
  REGION 1..700: note = Ceres Annot ID no. 1453426
  REGION 488..674: note = Pfam Name: Alpha-L-AF_C Pfam Description: Alpha-L-arabinofuranosidase C-terminus
  REGION 70..233: note = Pfam Name: CBM_4_9 Pfam Description: Carbohydrate binding domain
  REGION 1..700: note = Bit score of 1525.2 for HMM based on sequences of Figure 6
  REGION 1..700: note = Functional Homolog Of SEQ ID NO. 774
MGYWKASCSVLLVCFFVGLCSVYQCSAAEVDAYQTAKLIVNASSGRPIPETLFGIFFEEINHAGAGGIWAELVSNRGFEAGGQNTPSNIAPWSIIGDQSSLTVSTDRSSCFERNKVALRMHVLCDSEGSNICPAGGVGIYNPGFWGMNIEQGKIYKVVLYVRSLGSINVSVSLTSSDGLQILATANIVDSDVSNWTKTEVLLEAKGTNPNSRLQLTTSRKGVIWFDQVSAMPLETYKGHGFQKELIEMLEDIKPQFIRFPGGCFVEGEWLRNAFRWKESIGPWEERPGHFGDVWMYWTDDGLGYFEFLQLSEDLGARPIWVFNNVWKKVQDSPVLKLQTHARTSNGALSVSNIICFESHNLLAGCSIVQSSTEALDGLEFARGASDSKWGSVRAAMGHPEPFDLKYVAVGNEDCWKKNYRGNYLKFYDAIKSAYPDIKIISNCDGSSHSLDHPADYYDFHIYTSASHLFSMTHQFDHTSRSGPKAFVSEYAVTGKDAGTGSLLAALAEAGFLIGLEKNSDIVEMASYAPLFVNDNDRRWNPDAIVFNSSMHYGTPSYWVLKFFRESSGATLLDAKLQTNSSSLVASAITWTNSVDGETYLKIKIVNFGNRHVSLKVSVDGLGLNSQLSGSTKTVLTSSNVMDENSFTDPNKVVPDLSLLENADKDMNIIIAPYSLTSLDLLTESNNIRMPQTDSSARSSI

SEQ ID NO: 806 - DNA, 2001 bp, Sorghum bicolor
  misc_feature 1..2001: note = Ceres Annot ID no. 8657414
  misc_feature 1..2001: note = Encodes the peptide sequence at SEQ ID NO. 807
  source 1..2001: mol_type = other DNA
atgggcgtgcagagagccaatggcgcttccttgctccgtgcactagttgttgtgtgcgccctgtgctgggcattgtcttctcggtgtgcggaggggcagaactcaaatggtcagctgagtgtgaatgcctcgccacagaatgctaggaagatccctgataagatgtttggtatctttttcgaggagatcaaccatgctggagctggtgggttgtgggcagagcttgtaagcaacagaggattcgaggccggtgggcctaatacaccttccaatattgatccatggctgatcattggggatgaatcaagtatcattgttggaactgatcggacatcatgctttgaacgtaacccggttgcacttcggatggaagttctttgtgcttctaagaaaactaatgcctgcccgtcaggaggtgttggggtctataatcctggttactggggcatgaacattgaaaaaggaaaggtttataaggtgagcctgcatattaggtcatcagacacagtgtccttgactgtttccttgacaagctccgatggtctacaaaaacttgctgctcacaccatcacaggtagcaagaaaacctttgcaaaatggacaaagatagaatttcatttgagatccaaccaaaataacaccaactcaaggcttcaacttacaacaagtaaaagtggggtagtttggcttgatcaagtatcagttatgccaatggacacttacatggggcatggttttcggaaagatcttgcttctatgttggccaatctcaagcctcagtttctcaagtttccaggcggcaactatgccatgggaaattatctacgaaatgcatttcggtggagtgagactgttgggccatgggaggaaagacctggtcactttaatgatgcctggggatactggactgatgatggacttggattttttgagttccttcagttggctgaagaccttggtgcttccccagtttgggtggtgaatgatggagcaagccttaatgaagaagtttccacaaaaacaattgcttcattggttaaggatgttgttaatggcatagagtttgccaggggaggacccaagacaacttggggttcagttcgcgcatcaatgggacacccagaatcgtttaagcttgattatgtttcaataggaaatcaagaatgttggatgctgtactacagaggaaattaccaaaagttttactctgcgattaaatctgcctacccagacatcaacattatatcaagttgtgataggccaactatttcaccatccaaccctgccgatctttatgatgttcatgtctacacctctttgactaatatgttttcaaaaactagtatgtttgacaacacaccacgtggagcaccgaaggcaattgttagtgagtacgctgtgactgggaatgatgctggcaaaggaacactggtagcagcacttgcagaagctgcatttctcattggattggaaaggaacagtgatgtggttgagatggcaagctgtgcacccctttttgtaaatgacaatgatcgcaggtggagcccagatgccatcgtcttcaactcatggcagcactatgggtgtcccaactattggatgctacacttcttcaaggaatctagtggcgccacccttcatcctacagccatccagatctccaactatgatcagctgcttgcgtctgccatcacttggcagaatgctaaggacaggagcacttacctcaggataaaggtggtcaattttggcaaccaagctgtggatctcaacatatccattgcggaactgcccactggcatcaagaagtctggatcgaaacagatggttctaacatccagcagcccgcttgacgagaactccttccagcagccagagaaggtggtgccagtgttgagcccaatggtgaacgtggggcagcagatgggcgcgtccgtggggccctactccctcacctcgtttgatctgctgctggagccgagcaagcatgacagcatttga

SEQ ID NO: 807 - protein, 666 aa, Sorghum bicolor
  REGION 1..666: note = Ceres Annot ID no. 8657414
  REGION 463..650: note = Pfam Name: Alpha-L-AF_C Pfam Description: Alpha-L-arabinofuranosidase C-terminus
  REGION 73..238: note = Pfam Name: CBM_4_9 Pfam Description: Carbohydrate binding domain
  REGION 1..666: note = Bit score of 1237.0 for HMM based on sequences of Figure 6
  REGION 1..666: note = Functional Homolog Of SEQ ID NO. 774
MGVQRANGASLLRALVVVCALCWALSSRCAEGQNSNGQLSVNASPQNARKIPDKMFGIFFEEINHAGAGGLWAELVSNRGFEAGGPNTPSNIDPWLIIGDESSIIVGTDRTSCFERNPVALRMEVLCASKKTNACPSGGVGVYNPGYWGMNIEKGKVYKVSLHIRSSDTVSLTVSLTSSDGLQKLAAHTITGSKKTFAKWTKIEFHLRSNQNNTNSRLQLTTSKSGVVWLDQVSVMPMDTYMGHGFRKDLASMLANLKPQFLKFPGGNYAMGNYLRNAFRWSETVGPWEERPGHFNDAWGYWTDDGLGFFEFLQLAEDLGASPVWVVNDGASLNEEVSTKTIASLVKDVVNGIEFARGGPKTTWGSVRASMGHPESFKLDYVSIGNQECWMLYYRGNYQKFYSAIKSAYPDINIISSCDRPTISPSNPADLYDVHVYTSLTNMFSKTSMFDNTPRGAPKAIVSEYAVTGNDAGKGTLVAALAEAAFLIGLERNSDVVEMASCAPLFVNDNDRRWSPDAIVFNSWQHYGCPNYWMLHFFKESSGATLHPTAIQISNYDQLLASAITWQNAKDRSTYLRIKVVNFGNQAVDLNISIAELPTGIKKSGSKQMVLTSSSPLDENSFQQPEKVVPVLSPMVNVGQQMGASVGPYSLTSFDLLLEPSKHDSI

SEQ ID NO: 808 - protein, 675 aa, Oryza sativa
  REGION 1..675: note = Public GI ID no. 108707861
  REGION 462..649: note = Pfam Name: Alpha-L-AF_C Pfam Description: Alpha-L-arabinofuranosidase C-terminus
  REGION 72..237: note = Pfam Name: CBM_4_9 Pfam Description: Carbohydrate binding domain
  REGION 1..675: note = Bit score of 1270.2 for HMM based on sequences of Figure 6
  REGION 1..675: note = Functional Homolog Of SEQ ID NO. 774
  source 1..675: note = Oryza sativa subsp. japonica
MGVRRGRLDSSLFHMLVLVCALSQVLFVGLVTGQTAQLSVDASSQNGRTIPDKMFGIFFEELNHAGAGGLWAELVSNRGFEAGGINTPSNIDPWLIIGDESNIIVETDRSSCFASNPIALRMEVLCGATGTNACPSGGVGIYNPGYWGMNIEKTKVYKVSMYIRSSDSVDLAVSLTSSDGLQNLATHTITAEKGDFAGWTKVEFDLQSSERNTSSRLQLTTTKNGIIWFDQVSVMPSDTYMGHGFRKDLATMLANLKPRFLKFPGGNYVMGNYLLNAFRWSETIGPWEERPGHFNDVWNYWTDDGLGFFEFLQLAEDLDACPVWVINDGASLNEQIPSATIAAFVKDVVDGIEFARGDPKTTWGSVRAAMGHPEPFPLYYISVGNQECSKPYYKEKYVKFYSAIKASYPDIKIISSCDISSISAVNPADLYDVHVYTSSGDMFSKTRMFDSTPRSGPKAFVSEYAVTGNDAGRGTLVAALAEAAFLIGLERNSDVVEMASCAPLFINDNDRGFSPDAIVFNSWQHYGCPNYWMLHFFKDSSGATLHPLTIQVSNYDQLAASALTWQNSNDGNTYLKIKVVNFGNKAVNLNIAVAGLENGIQEFGSIKTVLTSGWLRDENSFQQPDKVVPAASPITNAGEKMGVIVDPYSLTSFDLLLDTNTDKYPLLESSFHSSM

SEQ ID NO: 809 - DNA, 2049 bp, Populus balsamifera
  misc_feature 1..2049: note = Ceres Annot ID no. 1528070
  misc_feature 1..2049: note = Encodes the peptide sequence at SEQ ID NO. 810
  source 1..2049: mol_type = other DNA
atgagtagttgcaaggcctcttgcagtgttcttttggcgtgcttcattgttggtctttgttctgtgtgccaatgttctgctgctgaagttgatgcaaaccagacagcaaacttgatcatcaatggctccagtacccggcctattcctgaaacactctttggaattttcttcgaggagataaaccatgctggagctggtgggatatgggcagagcttgtaaacaatcggggttttgaagccgggggccaaaacactccctcaaatattgctccctggtctatcattggtgatcagtcatctttaattgtatctactgaccgttcttcttgcttcgagcgaaacaaggttgctctccgaatggatgtgctctgtgacagcacgggcggtaatatttgcccagctggtggagttggtatatacaatccagggttttggggcatgaatattgaacaagggaaggcctataaagtggttctttatgtccgttctctgggatcaatcaatgtttctgtatcattgacgagctcagatgggtcgcagatattggcatctgctaacattgtagattctgatgtttcaaactggacaaaggctgaggttctattggaagccaaaggaacaaatcctaattcaaggcttcaattgactacatccagaaaaggtgtaatatggtttgatcaagtgtcagctatgcctctggacacatacaaggggcatggtttccgaaatgagctcattgaaatgatcgatgatataaaaccccaatttgtcagatttccaggtggctgctttgttgagggtgaatggttgagaaacgcatttcgctggaaggaaagcattggaccctgggaggagagacctgggcactttggtgatgtttggatgtattggactgatgatggacttggatactttgagtttcttcaattaactgaagatcttggtgcacggccaatatgggtgttcaacaatggaatcagtcatcaggatcaagttgatactactgcagtctcaccttttgtacaagaagcccttgatggtcttgagtttgccagaggcgattctaattctaagtggggttctgtcagagccgcaatggggcatccagagccttttgacttgaaatatgttgctgttgggaatgaggattgcgggaagaagaattaccgagcattactgcatcactcatttttgcatttaccttttaggggacgtattatggaagatagaccagtttcagaactcaaattcatgtgcttttttctaccaggaaattatctcaagttctacaatgccataagaagtgcctatcctgacatcaaaataatctcaaactgtgatgggtcttctcgttctttggatcacccagctgattactatgattatcatgtttatacatctgccagcaacctgttttctatgactcataagtttgattgcacatcccgcagttgtccaaaggcttctgtgagcaacgatgctgtgactggaaaagatgcgggcacaggaagtcttttagctgcactcgctgaagccggattcctcattggtctaaaaaggaacaggtggaatccagatgcaattgtcttcaactcatcaaagcactatggaactccgagctactgggtgcaaaaattcttcagagagtcaagtggagcaactcttcttgacgctaagctacagacaaattcctctacacttgttgcatctgcaattacttggcaaaattcagatcaaacttacctgaaaataaagattgtgaattttgggaacagcaaagtgaatctcaaagtttccattgatggattggggctcagctcacaattgtctggatcaacaaaaactgtgctcacttcttctaacttaatggacgagaattccttcgcgaatccaaaaaaggtggtgccagcacaaactatgctcgagaatgctgacaaagacatggatgttgtactctctccatattccttaacttcatttgatttgttaacagaatcaaacaatatcaggatgccacaaactgattctctctcaagatcatcaatttag

SEQ ID NO: 810 - protein, 682 aa, Populus trichocarpa
  REGION 1..682: note = Ceres Annot ID no. 1528070
  REGION 494..656: note = Pfam Name: Alpha-L-AF_C Pfam Description: Alpha-L-arabinofuranosidase C-terminus
  REGION 70..233: note = Pfam Name: CBM_4_9 Pfam Description: Carbohydrate binding domain
  REGION 1..682: note = Bit score of 1436.2 for HMM based on sequences of Figure 6
  REGION 1..682: note = Functional Homolog Of SEQ ID NO. 774
MSSCKASCSVLLACFIVGLCSVCQCSAAEVDANQTANLIINGSSTRPIPETLFGIFFEEINHAGAGGIWAELVNNRGFEAGGQNTPSNIAPWSIIGDQSSLIVSTDRSSCFERNKVALRMDVLCDSTGGNICPAGGVGIYNPGFWGMNIEQGKAYKVVLYVRSLGSINVSVSLTSSDGSQILASANIVDSDVSNWTKAEVLLEAKGTNPNSRLQLTTSRKGVIWFDQVSAMPLDTYKGHGFRNELIEMIDDIKPQFVRFPGGCFVEGEWLRNAFRWKESIGPWEERPGHFGDVWMYWTDDGLGYFEFLQLTEDLGARPIWVFNNGISHQDQVDTTAVSPFVQEALDGLEFARGDSNSKWGSVRAAMGHPEPFDLKYVAVGNEDCGKKNYRALLHHSFLHLPFRGRIMEDRPVSELKFMCFFLPGNYLKFYNAIRSAYPDIKIISNCDGSSRSLDHPADYYDYHVYTSASNLFSMTHKFDCTSRSCPKASVSNDAVTGKDAGTGSLLAALAEAGFLIGLKRNRWNPDAIVFNSSKHYGTPSYWVQKFFRESSGATLLDAKLQTNSSTLVASAITWQNSDQTYLKIKIVNFGNSKVNLKVSIDGLGLSSQLSGSTKTVLTSSNLMDENSFANPKKVVPAQTMLENADKDMDVVLSPYSLTSFDLLTESNNIRMPQTDSLSRSSI

SEQ ID NO: 811 - protein, 674 aa, Arabidopsis thaliana
  REGION 1..674: note = Public GI ID no. 22327075
  REGION 463..646: note = Pfam Name: Alpha-L-AF_C Pfam Description: Alpha-L-arabinofuranosidase C-terminus,
  REGION 57..127: note = Pfam Name: CBM_4_9 Pfam Description: Carbohydrate binding domain
  REGION 1..674: note = Bit score of 1394.4 for HMM based on sequences of Figure 6
  REGION 1..674: note = Functional Homolog Of SEQ ID NO. 774
MDMETSWRFLRSVCLLSFILGSFSVYQTLCLVDAQEDAIVTLQVDASNVTRRPIPETLFGIFFEEINHAGAGGLWAELVSNRGFEAGGQIIPSNIWPWSIIGDESSIYVVTDRSSCFERNKIALRMEVLCDSNSCPLGGVGVYNPGYWGMNIEEGKKYKVVLYVRSTGDIDVSVSFTSSNGSVTLASENIIALASDLLNWTKKEMLLEANGTDNGARLQFTTTKKGSIWFDQVSAMPMDTYKGHGFRNDLFQMMVDLKPRFIRFPGGCFVEGDWLGNAFRWKETVRAWEERPGHYGDVWKYWTDDGLGHFEFFQLAEDLGASPIWVFNNGISHNDQVETKNVMPFVQEAIDGIEFARGDSNSTWGSVRAAMGHPEPFELKYVAVGNEDCFKSYYRGNYLEFYNAIKKAYPDIKIISNCDASAKPLDHPADYFDYHIYTLARDLFSKSHDFDNTPRNGPKAFVSEYAVNKADAKNGNLLAALGEAAFLLGLEKNSDIVEMVSYAPLFVNTNDRRWIPDAIVFNSSHLYGTPSYWVQHFFTESSGATLLNSTLKGKTSSVEASAISFQTNGKDYIQIKAVNFGEQSVNLKVAVTGLMAKFYGSKKKVLTSASVMDENSFSNPNMIVPQESLLEMTEQEDLMFVLPPHSFSSFDLLTESENVIKMPISDSYKKTSTM

SEQ ID NO: 812 - protein, 654 aa, Daucus carota
  REGION 1..654: note = Public GI ID no. 50507838
  REGION 455..645: note = Pfam Name: Alpha-L-AF_C Pfam Description: Alpha-L-arabinofuranosidase C-terminus,
  REGION 57..126: note = Pfam Name: CBM_4_9 Pfam Description: Carbohydrate binding domain
  REGION 1..654: note = Bit score of 1304.1 for HMM based on sequences of Figure 6
  REGION 1..654: note = Functional Homolog Of SEQ ID NO. 774
MGFSRGPCSVLVCILVGLCSFYPCSGTDITAQLFVNASKQSARTIPDTLFGIFFEEINHAGAGGLWAELVDNRGFEAGGQATPSDIAPWFIIGDESLVVLSTDRSSCFDRNKIALRMDVLCDSKGPLICPAGGVGVYNPGFWGMNIEQGKSYKLILYLRSYNPINVSVSLTDSTGSQPLATSNIIASSVSNWTRMEFLFVAKATNPNSRLQFTTTQAGVIWFDQVSLMPVDTYKGLGFREDLFQLLADLKPAFLRFPGGCFVEGGRLPNAVRWKDTIGPWEERPGHYGDVWDYWTDDGLGHFEFFQLAEDLGALPIWVFNNGISLHGEVNMSVILPFIHEVLDGLEFAKGDASTTWGSVRAALGHPEPFDLRYVAIGNEECPIQGYRGNYLKFYQAIKHYYPEIKIISNCDGSSQKLDHPADLYDYHIYTSANNMFSKYNAFDYVARDGPKAFVSEYAVTPKEDAGTGSLLAALAEAGFLLGLERNSDIVEMASYAPLFVNTNDRHWNPDAIVLNSAKAYGTPSYWMQQFFIESNGATLLNSTLQASSTNSLHASAIIWKNTDDATYYLRLKFVNIGSVPVSMKISIDGVKINTKSALSTVLTSDNVMDENSFDKPAKVTPVRAPLTANVELDGTEMTFTLAQHSLTSIDVLTT

SEQ ID NO: 813 - protein, 679 aa, Physcomitrella patens
  REGION 1..679: note = Public GI ID no. 168060089
  REGION 454..645: note = Pfam Name: Alpha-L-AF_C Pfam Description: Alpha-L-arabinofuranosidase C-terminus
  REGION 62..224: note = Pfam Name: CBM_4_9 Pfam Description: Carbohydrate binding domain
  REGION 1..679: note = Bit score of 1109.4 for HMM based on sequences of Figure 6
  REGION 1..679: note = Functional Homolog Of SEQ ID NO. 774
MANSLLCILVVAFTTHLVVPALAQSTVTLKVNATNPGRQIPSTLFGLFFEEINHAGDGGLWAELVQNRGFEAGGLNVPSIIEPWYKIGTAAQITIGTECSSPHARNPVALKIEVLCDNNDASLQCPKGGVGVANPGFWGMNILSGSKYRVEYWLKTTSSFNLSVAFTSANGTVLAQEHVSLNAGEWRKYSVVLMATSTDHNARLSLTSGTRSVFWVDQVSGMPTDTFKARKGLGHGFRKELATMISDLKPGFLRFPGGCYVEGARLVNAFRWRDSVGPYENRPGHYGDVWYYWSDDGFGYFEGLQLAEDLGAAPIWVFNNGISHEQSVSTDVIGPWVQDVLEGIEFARGPVSSKYGAMRASMGHPDPFPLHHVAIGNEDCYKPYYKENYMEFYKAIKLLYPDIQVISNCDGSGAALDHPADLYDYHIYTNANNLFSMRHQFDKTSRSGPKAFVSEYAVTGSDSGKGSLLASLAEGAFLIGLELNSDVVHMASYAPLFVNDNDRRWNPDAIVFNSWQQYGTPSYWVQQFFKKSNGAYLISSTMEADSASALANLATSAVRTYNASTGMEYMIVKAVNFGSSALNLSIAVSGISANNVVAADSHITVMTSGAVMDENSFTNPKKVVPQVSQAENAAPNMQILLPAHSITALELGLLPTKSSTATLEVTQVTSKDSKAPFLV

SEQ ID NO: 814 - protein, 649 aa, Bacteroides uniformis
  REGION 1..649: note = Public GI ID no. 160890886
  REGION 1..649: note = Bacteroides uniformis ATCC 8492
  REGION 451..636: note = Pfam Name: Alpha-L-AF_C Pfam Description: Alpha-L-arabinofuranosidase C-terminus
  REGION 56..202: note = Pfam Name: CBM_4_9 Pfam Description: Carbohydrate binding domain
  REGION 1..649: note = Bit score of 376.6 for HMM based on sequences of Figure 6
  REGION 1..649: note = Functional Homolog Of SEQ ID NO. 774
MKRLLFLLTLFVVLGMQAQQHVMTVDVSKPTARINPAMYGIFFEDINFGADGGLYAELVKNRSFEFPQPLVGWIPFGEVTVQDERPCFDRNPHYVRITNDGCLLRAGLDNEGYRGIGLKKGEDYRFSAYVRTPDTKPMKLSVELVNSNGENLLKKELEVKGSEWQKLTAVLKAPFTDVRSRLRVVLQTEGTVDMDHISLFPVNTWKKRENGLRADLVQALYDLNPGVFRFPGGCIIEGNSLATRYQWKNSVGPVENRPLNENRWNYTFKHKAFPDYFQSYGLGFYEYFLLSEDLGAEPLPVLSCGLSCQYESNEVVPLGELGPYVQDALDLIEFANGAATSKWGKVRADMGHPEPFGLKMIAIGNEQWGEVYPERLEVFTKAIRAEYPDMQIVGSSGPSADGDKFDYLWPEMKRIGVDLVDEHYYMAPDWFFANAARYDDYDRKGPKVFAGEYASHDHPTGKANNFLAALSEAAFMTGLERNADVVRLATYAPLFAHVDAWQWNPDLIWFDNLRMMRTPNYYVQQMYGMNAGTDVLNLQMDGKPVTGQDSLYASAVLDAPTGEVILKLVNAGSRSEKVQIEFSGLKKRQLVSGSCTYLQSDDWKAKNTLEQEAIVPRIRPVEVASRSLSLELQPRSFGVYRLRISTQSK

SEQ ID NO: 815 - protein, 643 aa, Bacteroides intestinalis
  REGION 1..643: note = Public GI ID no. 189464007
  REGION 1..643: note = Bacteroides intestinalis DSM 17393
  REGION 451..636: note = Pfam Name: Alpha-L-AF_C Pfam Description: Alpha-L-arabinofuranosidase C-terminus
  REGION 56..202: note = Pfam Name: CBM_4_9 Pfam Description: Carbohydrate binding domain
  REGION 1..643: note = Bit score of 345.7 for HMM based on sequences of Figure 6
  REGION 1..643: note = Functional Homolog Of SEQ ID NO. 774
MRKLTALFALSLALSMQAQQHVMTVDVSKPTAKIQPEMYGIFFEDINFGADGGLYAELVKNRSFEFPQPFVGWVPFGNVTVQDANPCFDRNPHYVRVVNDGRLLRAGLDNEGYRGIGVKQGEEYRFSVYARTPDAKPMKLSIELVNSNAQNLLKKEIEVSGNNWQKLTAVLKSPFTDAHARLRIVLETRGTVDMDHISLFPVNTWKGRENGLRADLAQALYDLNPGVFRFPGGCIIEGNSLETRYQWKNSVGPVENRPLNENRWNYTFKHKAFPDYFQTLGLGYFEYFLLSEDLGAEPLPVISCGLSCQYESNEVVPMDALDPYIQDALDLIEFANGPVTSKWGKVRADMGHPEPFNLKMIGIGNEQWDKVYVERLEAFTKAIRAKYPDVKVVGSSGPSASGDKFDYLWPEMKRIGVDLVDEHYYMNPDWFFGNASRYDNYDRKGPKVFAGEYASHDHSTKKDNNFLAALSEAAFMTGLERNADVVHLATYAPLFAHVDAWQWNPDLIWFDNLRMMRTPNYYVQQMYGMNAGTDVLSLKMDGKAVVGQDSLYATAALNAPTGEIILKLVNASSKPADVQIDFNGLKKRQLVAGSCTYLQNDNWRTVNTLDQEAIVPRVRPVQVEGQSLKLKLEPRSFGVYRIQ

SEQ ID NO: 816 - protein, 651 aa, Parabacteroides merdae
  REGION 1..651: note = Public GI ID no. 154492683
  REGION 1..651: note = Parabacteroides merdae ATCC 43184
  REGION 460..643: note = Pfam Name: Alpha-L-AF_C Pfam Description: Alpha-L-arabinofuranosidase C-terminus
  REGION 61..208: note = Pfam Name: CBM_4_9 Pfam Description: Carbohydrate binding domain
  REGION 1..651: note = Bit score of 348.5 for HMM based on sequences of Figure 6
  REGION 1..651: note = Functional Homolog Of SEQ ID NO. 774
MTKSMKKAIALCLFSMGVVGLMAQSNEFKIDVQKTGAPIQSTMYGIFFEDINYGADGGLYAELVKNRSFEFENPFGGWTPFGNVSVQTQKPCFDRNPHYVRLSYEKELTGTGLDNEGFNGIGIREGEKYDFSLYARTRSGDAPVKLRINLVDSRNDLYEQKEIEVSGKEWKKYTVVLTPGATEARSRLRITMVTKGIVDLEHISLFPQKTFNNRPNGMRADLAQALKELKPGVFRFPGGCIVEGTNKATRYQWKNTVGPVENRPININRWNYTFSHKKFPDYYQSCGLGFFEYFLLSEDIGAEPLPVLNCGLSCQYENQDPNENCPVDKLQPYIDDALDLIEFANGSATSEWGKIRADMGHPAPFNLKLIAIGNEQWGPLYPERLELFVKAIRAKYPEIKIIGSSGPQSEGEDFDYLWPEMRRLKVDLVDEHFYRSPEWFLNGAKRYDSYDRQGPKVFAGEYACHSVNRENSFLTALCEAAFMTGFERNADVVCLCTYAPLFAHVDAWQWRPDLIWFDNLSLVKTPNYYVQQLYGHNAGTNVVPLTMQGEPVTGQLDLYATAAVDKHSDELIIKVANTGIRNKRIKLNLNGLSAGKHKGTLTLLHSSDLEAKNTLCNPSTVVPLVSDIEVEAPQGEVNLRPLSFSVYRIKL

SEQ ID NO: 817 - protein, 661 aa, Flavobacterium johnsoniae
  REGION 1..661: note = Public GI ID no. 146300858
  REGION 1..661: note = Flavobacterium johnsoniae UW101
  REGION 465..652: note = Pfam Name: Alpha-L-AF_C Pfam Description: Alpha-L-arabinofuranosidase C-terminus
  REGION 61..216: note = Pfam Name: CBM_4_9 Pfam Description: Carbohydrate binding domain
  REGION 1..661: note = Bit score of 364.4 for HMM based on sequences of Figure 6
  REGION 1..661: note = Functional Homolog Of SEQ ID NO. 774
MKNNFLSKSIFGCLLLSSLYTNAQKANLEVDASKTITKIQPTMFGLFFEDINFAADGGLYAEMIKNRSFEFDKPMMGWEQPNTKRSSLNKESGSALPINLSKEKNNSNFCRVEINNDKGYTLINEGFRGMGVKKDAKYNLSLKVANHNGAIKKIIFQLINKDQKIIGETSIVPKSEQWTNYTSQFTAVETEAKAKLKITFEGNGTIDLDMVSLFPEDTWKNRKNGLRKDLVQLLYDVKPGFLRFPGGCIVEGRTLSDRYQWKKSVGDVEERKTMMNRWNVEFNHKQTPDYFQSFGLGFFEYFQLSEDIGAEPLPILSCGMACQYNTGELAPMDELDPYIQDALDLIEFANSDVSTKWGKLRSDMGHPKPFNLKYIGVGNEQWGKDYIDRYKVFEKAIKAKYPKIIIVSGTGPSPKGEHFDYAMTELKKLNAELIDEHYYESPKWFRENAGRYDNYDRKGPKIFAGEYAAQSVSGANPNNRNNWECAFSEAAFMTGLERNAEVVNMTSYAPLMAHEDAWQWTPDMIWFNNLQSYGSANYYVQQLFSTNKGTDLLSITQDGKALIGQNNLYASAVKDVNSKEIIVKLVNTAATNQEVSIDLKGAKLGSKGSVISLASGNLQDENTFVEPRKISPKQSEYKVTKGSQQLTLPAYSVTVLKLKTI

SEQ ID NO: 818 - protein, 655 aa, Parabacteroides distasonis
  REGION 1..655: note = Public GI ID no. 150008552
  REGION 1..655: note = Parabacteroides distasonis ATCC 8503
  REGION 464..647: note = Pfam Name: Alpha-L-AF_C Pfam Description: Alpha-L-arabinofuranosidase C-terminus
  REGION 66..212: note = Pfam Name: CBM_4_9 Pfam Description: Carbohydrate binding domain
  REGION 1..655: note = Bit score of 343.4 for HMM based on sequences of Figure 6
  REGION 1..655: note = Functional Homolog Of SEQ ID NO. 774
MRRKNMKKTAALFLLSVGVNCMTAQDIVPVHEFDIDIQKVGSPIQSTMYGIFFEDINFGADGGLYAELIKNRSFEFENPWGGWEPFGDVSIAEKNPCFNKNPHYAHLTYTGQITGTGLENEGFKGIGIKADENYDFSLYARTETNNPIKLRIELVNRDNDIYETQHLEIKGKDWKKYSVILSPKATEAKSRLRITMETAGTLDMEHISLFPEKTFNNRTNGLRRDLAQALKDLKPGIFRFPGGCIVEGTTIATRYQWKNTVGPVENRPINISRWNYTFPHKKFPDYYQSYGLGFFEYFQLSEDIGAEPLPVLNCGLSCQFENEGMDQHVPVDKLQPYIDDALDLIEFANGPITSQWGKVRADMGHPASFNLKFIAIGNEQWGPLYPERLEPFVKAIRAKYPEIKIIGSSGPDSEGKDFEYLWPEMKRLKVDLVDEHFYRSPEWFLNSAKRYDSYDRQGPKVFAGEYACHPTNRENSFLTALCEAAFMTGLERNADVVELCTYAPLFAHVDAWQWRPDLIWFNNLNIVKTPNYYVQQLYGHNAGTNVLPLTMNKEAVTGQSELFATAALDKGTNELIIKIVNTGIQSKKIQLNLNGISSGKHKGKLMVLHASDLEAKNTLGKPETVIPIESAVELEAPATEVSVQPLSFLVYRISL

SEQ ID NO: 819 - protein, 664 aa, Leeuwenhoekiella blandensis
  REGION 1..664: note = Public GI ID no. 86142284
  REGION 1..664: note = Ceres Seed Line no. MED217
  REGION 1..664: note = Leeuwenhoekiella blandensis MED217
  REGION 468..655: note = Pfam Name: Alpha-L-AF_C Pfam Description: Alpha-L-arabinofuranosidase C-terminus
  REGION 64..219: note = Pfam Name: CBM_4_9 Pfam Description: Carbohydrate binding domain
  REGION 1..664: note = Bit score of 315.7 for HMM based on sequences of Figure 6
  REGION 1..664: note = Functional Homolog Of SEQ ID NO. 774
MITQTIKKAGLAAVLAGTFLAGNTLFAQKELTVDMSETIAPIQPTMYGIFFEDINFAADGGLYAEMIKNRSFEFTISMMGWSQPNSDRHSYNNESGYALPVKYFEGEGNLNFLRVQIKNAKGYELHNEGFRGMGIKEGDTYRFTFDAKQMEGAVSAVKAELLDEEGNTIAEASIPVSGSEWANYKAEIVPNKTVMKGSLKLTFEGTGELGLDMISLFPTDTWNGRENGLRKDLVQLLYDLDPGFLRFPGGCIVEGRTLARRYQWKKTVGPVDERPSLVNRWNTEFDHRLTPDYYQSFGLGFFEYFQLSEDLGAEPLPILSCGIACQFNTGELVPMDELDSYVQDALDLIEFANGSTDTPWGKVRADMGHPEPFNMKYIGVGNEQWGPEYIERYKVFNEAIAEKYPEIIIVSGSGPFPDGDYFEYGMKELKKIGAEIIDEHYYRSPEWFRENATRYYSYDRNGPKIFAGEYAAQSVAIASPDNKNNWETALSEAAFMTGLERNAEVVQLTSYAPLMAHAEGWQWTPDMIWFNNLESYGTPNYYVQKLYSTNKGTDLISVTQDGENLVGQEELYASATLDSEANEVVVKVVNTSSEAQEIQLNFEGKRLKSKGSIIVLKEADLTQENSFESTQEIAPVTEELKVKKDVATYEVSAYSLNIIRIPLK

SEQ ID NO: 820 - protein, 644 aa, Thermotoga petrophila
  REGION 1..644: note = Public GI ID no. 148269769
  REGION 1..644: note = Thermotoga petrophila RKU-1
  REGION 451..635: note = Pfam Name: Alpha-L-AF_C Pfam Description: Alpha-L-arabinofuranosidase C-terminus
  REGION 67..216: note = Pfam Name: CBM_4_9 Pfam Description: Carbohydrate binding domain
  REGION 1..644: note = Bit score of 373.1 for HMM based on sequences of Figure 6
  REGION 1..644: note = Functional Homolog Of SEQ ID NO. 774
MEKNDLRGEKVKRFLFVLTLTISVLLVGEVQHVLRIDFSRQGPEIPETFHGIFFEDINHAVDGGLYVELVRNRSFEQKTRKYEGWQIERGDSVKSSIEETYPLNENNTHYFELKFPETDRATLTNLGYGGIVVFQGQEYTFSTYLSGDFTGTITALITDDNEVLASGNVLLHQPAGGWKKYMLNLIPTKTSTNSRLSISILGSGTLRIDMVSLMPRKNWNGMREDLLRMLEDLKPGFIRFPGGCLVQGNTLENAYRWKESIGSVEQRKTKWNFWGYYQTLGIGFYEYLLLCERLEAEPVPIFNPGISFQIESPEYASEEELKEWIQDVLDFLEFANDATDTYWGGVRASLGHPEPFNVKYIGVGNENWGPRYWENFEKFREAIKKRYPDVKIIFSGPPSYEGTDFRQAWRWARENNVEIFDEHIYASPEWMLANTDRYNRYDRNGPKVMLGEYAAHTDGKRNNWQAALAEAAFLTGVERNSDVVIMASYAPLFNRVGWSQWVPDLIWFDGYRVFGTPSYYVQRVFAENRGDVVIHSELTNEEYRMFGYRYKHLYHVVTYDEKSKELIIKVVNPWPEDRTVRLEIQGIGLEGNGKEILISGGPKDENSFDELKIVPKERIITGLNTSFEYTFKAYTVTVLRLKVR

SEQ ID NO: 821 - protein, 634 aa, Thermotoga sp.
  REGION 1..634: note = Public GI ID no. 170288456
  REGION 1..634: note = Thermotoga sp. RQ2
  REGION 441..625: note = Pfam Name: Alpha-L-AF_C Pfam Description: Alpha-L-arabinofuranosidase C-terminus
  REGION 57..206: note = Pfam Name: CBM_4_9 Pfam Description: Carbohydrate binding domain
  REGION 1..634: note = Bit score of 358.7 for HMM based on sequences of Figure 6
  REGION 1..634: note = Functional Homolog Of SEQ ID NO. 774
  source 1..634: note = Thermotoga
MKRFLFVLTLTISVLLVGEVQHVLRIDFSRQGPEIPETFHGIFFEDINHAVDGGLYVELVRNRSFEQKTRKYEGWQIERGDSVKSSIEETYPLNENNTHYFELKFPETDRATLTNLGYGGIVVFQGQEYTFSTYLSGDFTGTITALITDDNEVLASGNVLLHQPAGGWKKYMLNLIPTKTSTNSRLSISILGSGTLRIDMVSLMPRKNWNGMREDLLRMLEDLKPGFIRFPGGCLVQGNTLENAYRWKESIGSVEQRKTKWNFWGYYQTLGIGFYEYLLLCERLEAEPVPIFNPGISFQIESPEYASEEELKEWIQDVLDFLEFANDATDTYWGGVRASLGHPEPFNVKYIGVGNENWGPRYWENFEKFREAIKKRYPDVKIIFSGPPSYEGTDFRQAWRWARENNVEIFDEHIYASPEWMLANTDRYNRYDRNGPKVMLGEYAAHTDGKRNNWQAALAEAAFLTGVERNSDVVIMASYAPLFNRVGWSQWVPDLIWFDGYRVFGTPSYYVQRVFAENRGDVVIHSELTNEEYRMFGYRYKHLYHVVTYDEKSKELIIKVVNPWPEDRTVRLEIQGIGLEGNGKEILISGGPKDENSFDELKIVPKERIITGLNTSFEYTFKAYTVTVLRLKVR

SEQ ID NO: 822 - DNA, 1180 bp, Triticum aestivum
  misc_feature 1..1180: note = Ceres Clone ID no. 933491
  misc_feature 1..1180: note = Encodes the peptide sequence at SEQ ID NO. 823
  source 1..1180: mol_type = other DNA
aagacaaagcatagatttcatagatacatagatagtcgatcttgacgtcgtccagcaaagatgggaaagccgggagcgttggttccagtgatagctctagcttttgcattggttcttggcctcgtgtctggcggcaacttttacgacgaatgcgacgctacgtgggagccccagaactgctggacctacgacggcggcaacagcctctccctcgccctcgtcagcaactcatcaggctcgatgatccggtccaagaggcagttcatatacgggacggtgtccaccatgatccaactcgtcaagggcgactccgccggcaccgtcacgacatactacacatcgtcggtgggagacgaccacgacgagatcgacttcgagttcctggggaacgagacgggccagccatacacgctgcacaccaacgtctacgccgccggcgtcggcggcaaggagatgcagttccgcccctggttcgaccccaccgacggctaccacaactacaccatctcctggacgccctgcacgatcgtctggtacgtcgacgggacgcccatccgggcgttccgcaactacgagcgcacccacggcgtggccttcccgacgagccgccccatgtacgcctactccagcatctgggcggccgaggactgggccacgcagggcggccgcgtcagggccgactggacccgcgcgcccttcgtggccagctaccgcggcatcgacctcgacgtctgcgagtgctacggcggcgactgcgtctacacatgcgcggcggcgttcggggcctgtggcgggctcaccggcgaacagcgggggaagatgcggtgggtgcaggacaagtacagaatatacgactactgcgctgatcacgaggccggcaaggtgcccggcgtcgagtgcaccctgccgcagtactgatgaagagcattcattcattgtgcatcatgccgttgccaaccacgtttattttgcactttccacagactatgttggacttcttttatctgctctgttcaaaatccgctcttcgattccaggcgttctgtatatcgaaataataagagctgggagctctttatttcttgtcaacgtgttttagcaccatttttaggtgtagatctatcttttagcccaaactactgtggtggagagcaaactgactatattgacggacttttgc

SEQ ID NO: 823 - protein, 870 aa, Triticum aestivum
  REGION 1..870: note = Ceres Clone ID no. 933491
  REGION 28..210: note = Pfam Name: Glyco_hydro_16 Pfam Description: Glycosyl hydrolases family 16
  REGION 244..272: note = Pfam Name: XET_C Pfam Description: Xyloglucan endo-transglycosylase (XET)
  REGION 1..870: note = Bit score of 234.6 for HMM based on sequences of Figure 11
  REGION 1..870: note = Functional Homolog Of SEQ ID NO. 641
METGLYLYSPROGLYALALEUVALPROVALILEALALEUALAPHEALALEUVALLEUGLYLEUVALSERGLYGLYASNPHETYRASPGLUCYSASPALATHRTRPGLUPROGLNASNCYSTRPTHRTYRASPGLYGLYASNSERLEUSERLEUALALEUVALSERASNSERSERGLYSERMETILEARGSERLYSARGGLNPHEILETYRGLYTHRVALSERTHRMETILEGLNLEUVALLYSGLYASPSERALAGLYTHRVALTHRTHRTYRTYRTHRSERSERVALGLYASPASPHISASPGLUILEASPPHEGLUPHELEUGLYASNGLUTHRGLYGLNPROTYRTHRLEUHISTHRASNVALTYRALAALAGLYVALGLYGLYLYSGLUMETGLNPHEARGPROTRPPHEASPPROTHRASPGLYTYRHISASNTYRTHRILESERTRPTHRPROCYSTHRILEVALTRPTYRVALASPGLYTHRPROILEARGALAPHEARGASNTYRGLUARGTHRHISGLYVALALAPHEPROTHRSERARGPROMETTYRALATYRSERSERILETRPALAALAGLUASPTRPALATHRGLNGLYGLYARGVALARGALAASPTRPTHRARGALAPROPHEVALALASERTYRARGGLYILEASPLEUASPVALCYSGLUCYSTYRGLYGLYASPCYSVALTYRTHRCYSALAALAALAPHEGLYALACYSGLYGLYLEUTHRGLYGLUGLNARGGLYLYSMETARGTRPVALGLNASPLYSTYRARGILETYRASPTYRCYSALAASPHISGLUALAGLYLYSVALPROGLYVALGLUCYSTHRLEUPROGLNTYRSEQUENCELISTING

The invention claimed is:

1. A method of producing a transgenic plant, said method comprising
    growing a plant cell comprising an exogenous nucleic acid, said exogenous nucleic acid comprising a regulatory region operably linked to a nucleic acid molecule, wherein the nucleic acid molecule comprises a polynucleotide sequence that encodes a polypeptide having 95 percent or greater sequence identity to the amino acid sequence of SEQ ID NO:348,
    regenerating the transgenic plant from the plant cell,
    selecting the transgenic plant for having an increased glucose release after acid pretreatment as compared to a control plant that does not comprise said exogenous nucleic acid.

2. The method of claim 1, wherein the polypeptide comprises the amino acid sequence of SEQ ID NO:348.

3. The method of claim 1, wherein the polypeptide comprises an amino acid sequence that has at least 96 percent sequence identity to the amino acid sequence of SEQ ID NO:348.

4. The method of claim 1, wherein said nucleic acid molecule comprises the polynucleotide sequence of SEQ ID NO:347.

5. A method of modulating biomass composition in a transgenic plant, said method comprising
    introducing into a plant cell an exogenous nucleic acid, said exogenous nucleic acid comprising a regulatory region operably linked to a nucleic acid molecule, wherein the nucleic acid molecule comprises a polynucleotide sequence that encodes a polypeptide having 95 percent or greater sequence identity to the amino acid sequence of SEQ ID NO:348, whereby the transgenic plant is obtained, and
    selecting the transgenic plant for having an increased glucose release after acid pretreatment as compared to a control plant that does not comprise said exogenous nucleic acid.

6. The method of claim 5, wherein the polypeptide comprises the amino acid sequence of SEQ ID NO:348.

7. The method of claim 5, wherein the polypeptide comprises an amino acid sequence that has at least 97 percent sequence identity to the amino acid sequence of SEQ ID NO:348.

8. The method of claim 5, wherein said polypeptide has 96 percent or greater sequence identity to the amino acid sequence of SEQ ID NO:348.

9. The method of claim 5, wherein said nucleic acid molecule comprises the polynucleotide sequence of SEQ ID NO:347.

10. A transgenic plant comprising an exogenous nucleic acid, said exogenous nucleic acid comprising a regulatory region operably linked to a nucleic acid molecule encoding a polypeptide having 95 percent or greater sequence identity to the amino acid sequence of SEQ ID NO:348,
    wherein said transgenic plant is selected for having an increased glucose release after acid pretreatment as compared to a control plant that does not comprise said exogenous nucleic acid.

11. A cell from the transgenic plant of claim 10, wherein the transgenic plant comprises the exogenous nucleic acid.

12. The transgenic plant of claim 10, wherein said plant is a member of a species selected from the group consisting of *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

13. The transgenic plant of claim 10, wherein said polypeptide comprises the amino acid sequence of SEQ ID NO:348.

14. A seed product comprising embryonic tissue from the transgenic plant according to claim 10, wherein the seed product comprises the exogenous nucleic acid.

15. The transgenic plant of claim 10, wherein said polypeptide comprises an amino acid sequence that has at least 96 percent sequence identity to the amino acid sequence of SEQ ID NO:348.

16. The transgenic plant of claim 10, wherein said polypeptide comprises the amino acid sequence of SEQ ID NO:348.

* * * * *

UNITED STATES PATENT AND TRADEMARK OFFICE
CERTIFICATE OF CORRECTION

PATENT NO. : 12,391,954 B2
APPLICATION NO. : 18/299406
DATED : August 19, 2025
INVENTOR(S) : Nestor Apuya Page 1 of 1

It is certified that error appears in the above-identified patent and that said Letters Patent is hereby corrected as shown below:

On the Title Page

Item (60), delete "Provisional application No. 61/407,282, filed on Oct. 27, 2010." and insert --Provisional application No. 61,407,280, filed on Oct. 27, 2010.--

Signed and Sealed this
Sixth Day of January, 2026

John A. Squires
*Director of the United States Patent and Trademark Office*